(12) United States Patent
Maianti et al.

(10) Patent No.: US 11,898,179 B2
(45) Date of Patent: Feb. 13, 2024

(54) SUPPRESSION OF PAIN BY GENE EDITING

(71) Applicant: President and Fellows of Harvard College, Cambridge, MA (US)

(72) Inventors: Juan Pablo Maianti, Revere, MA (US); David R. Liu, Lexington, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 837 days.

(21) Appl. No.: 16/492,548

(22) PCT Filed: Mar. 9, 2018

(86) PCT No.: PCT/US2018/021664
§ 371 (c)(1),
(2) Date: Sep. 9, 2019

(87) PCT Pub. No.: WO2018/165504
PCT Pub. Date: Sep. 13, 2018

(65) Prior Publication Data
US 2021/0115428 A1     Apr. 22, 2021

Related U.S. Application Data

(60) Provisional application No. 62/469,408, filed on Mar. 9, 2017.

(51) Int. Cl.
| | |
|---|---|
| *C12N 9/78* | (2006.01) |
| *A61K 9/00* | (2006.01) |
| *A61K 31/7088* | (2006.01) |
| *A61K 38/46* | (2006.01) |
| *C12N 9/22* | (2006.01) |
| *C12N 9/96* | (2006.01) |
| *A61K 48/00* | (2006.01) |
| *C12N 15/11* | (2006.01) |
| *A61K 38/50* | (2006.01) |

(52) U.S. Cl.
CPC .............. *C12N 9/78* (2013.01); *A61K 9/0029* (2013.01); *A61K 9/0053* (2013.01); *A61K 31/7088* (2013.01); *A61K 38/465* (2013.01); *A61K 38/50* (2013.01); *C12N 9/22* (2013.01); *C12N 9/96* (2013.01); *C12N 15/11* (2013.01); *C12Y 305/04* (2013.01); *A61K 48/00* (2013.01); *C07K 2319/00* (2013.01); *C12N 2310/20* (2017.05); *C12N 2320/31* (2013.01); *C12N 2320/32* (2013.01); *C12N 2800/80* (2013.01)

(58) Field of Classification Search
CPC ........................................................ C12N 9/22
See application file for complete search history.

(56) References Cited

U.S. PATENT DOCUMENTS

| | | | |
|---|---|---|---|
| 4,182,449 | A | 1/1980 | Kozlow |
| 4,186,183 | A | 1/1980 | Steck et al. |
| 4,217,344 | A | 8/1980 | Vanlerberghe et al. |
| 4,235,871 | A | 11/1980 | Papahadjopoulos et al. |
| 4,261,975 | A | 4/1981 | Fullerton et al. |
| 4,485,054 | A | 11/1984 | Mezei et al. |
| 4,501,728 | A | 2/1985 | Geho et al. |
| 4,663,290 | A | 5/1987 | Weis et al. |
| 4,737,323 | A | 4/1988 | Martin et al. |
| 4,774,085 | A | 9/1988 | Fidler |
| 4,797,368 | A | 1/1989 | Carter et al. |
| 4,837,028 | A | 6/1989 | Allen |
| 4,873,316 | A | 10/1989 | Meade et al. |
| 4,880,635 | A | 11/1989 | Janoff et al. |
| 4,889,818 | A | 12/1989 | Gelfand et al. |
| 4,897,355 | A | 1/1990 | Eppstein et al. |
| 4,906,477 | A | 3/1990 | Kurono et al. |
| 4,911,928 | A | 3/1990 | Wallach |
| 4,917,951 | A | 4/1990 | Wallach |
| 4,920,016 | A | 4/1990 | Allen et al. |
| 4,921,757 | A | 5/1990 | Wheatley et al. |
| 4,946,787 | A | 8/1990 | Eppstein et al. |
| 4,965,185 | A | 10/1990 | Grischenko et al. |
| 5,017,492 | A | 5/1991 | Kotewicz et al. |
| 5,047,342 | A | 9/1991 | Chatterjee |
| 5,049,386 | A | 9/1991 | Eppstein et al. |

(Continued)

FOREIGN PATENT DOCUMENTS

| | | |
|---|---|---|
| AU | 2012244264 A1 | 11/2012 |
| AU | 2012354062 A1 | 7/2014 |

(Continued)

OTHER PUBLICATIONS

Estacion et al., "A Sodium Channel Gene SCN9A Polymorphism That Increases Nociceptor Excitability", Ann. Neurol., 2009, vol. 66, pp. 862-866.*

(Continued)

*Primary Examiner* — Suzanne M Noakes

(74) *Attorney, Agent, or Firm* — Wolf, Greenfield & Sacks, P.C.

(57) ABSTRACT

Provided herein are systems, compositions, kits, and methods for the suppression of pain (e.g., chronic pain). Genes encoding ion channels (e.g., SCN9A) responsible for the propagation pain signals in neurons (e.g., DRG neurons) may be edited using a genome editing agent (e.g., a nucleobase editor). In some embodiments, loss-of-function ion channel mutants are generated, leading to pain suppression. In some embodiments, the genome editing agent is administered locally to the site of pain or to the nerves responsible for propagation of the pain signal.

28 Claims, 9 Drawing Sheets

Specification includes a Sequence Listing.

(56) References Cited

U.S. PATENT DOCUMENTS

| | | |
|---|---|---|
| 5,079,352 A | 1/1992 | Gelfand et al. |
| 5,139,941 A | 8/1992 | Muzyczka et al. |
| 5,173,414 A | 12/1992 | Lebkowski et al. |
| 5,223,409 A | 6/1993 | Ladner et al. |
| 5,244,797 A | 9/1993 | Kotewicz et al. |
| 5,270,179 A | 12/1993 | Chatterjee |
| 5,374,553 A | 12/1994 | Gelfand et al. |
| 5,405,776 A | 4/1995 | Kotewicz et al. |
| 5,436,149 A | 7/1995 | Barnes |
| 5,449,639 A | 9/1995 | Wei et al. |
| 5,496,714 A | 3/1996 | Comb et al. |
| 5,512,462 A | 4/1996 | Cheng |
| 5,580,737 A | 12/1996 | Polisky et al. |
| 5,614,365 A | 3/1997 | Tabor et al. |
| 5,652,094 A | 7/1997 | Usman et al. |
| 5,658,727 A | 8/1997 | Barbas et al. |
| 5,668,005 A | 9/1997 | Kotewicz et al. |
| 5,677,152 A | 10/1997 | Birch et al. |
| 5,767,099 A | 6/1998 | Harris et al. |
| 5,780,053 A | 7/1998 | Ashley et al. |
| 5,830,430 A | 11/1998 | Unger et al. |
| 5,834,247 A | 11/1998 | Comb et al. |
| 5,835,699 A | 11/1998 | Kimura |
| 5,844,075 A | 12/1998 | Kawakami et al. |
| 5,849,548 A | 12/1998 | Haseloff et al. |
| 5,851,548 A | 12/1998 | Dattagupta et al. |
| 5,855,910 A | 1/1999 | Ashley et al. |
| 5,856,463 A | 1/1999 | Blankenborg et al. |
| 5,962,313 A | 10/1999 | Podsakoff et al. |
| 5,981,182 A | 11/1999 | Jacobs, Jr. et al. |
| 6,015,794 A | 1/2000 | Haseloff et al. |
| 6,057,153 A | 5/2000 | George et al. |
| 6,063,608 A | 5/2000 | Kotewicz et al. |
| 6,077,705 A | 6/2000 | Duan et al. |
| 6,156,509 A | 12/2000 | Schellenberger |
| 6,183,998 B1 | 2/2001 | Ivanov et al. |
| 6,355,415 B1 | 3/2002 | Wagner et al. |
| 6,429,298 B1 | 8/2002 | Ellington et al. |
| 6,453,242 B1 | 9/2002 | Eisenberg et al. |
| 6,479,264 B1 | 11/2002 | Louwrier |
| 6,503,717 B2 | 1/2003 | Case et al. |
| 6,534,261 B1 | 3/2003 | Cox, III et al. |
| 6,589,768 B1 | 7/2003 | Kotewicz et al. |
| 6,599,692 B1 | 7/2003 | Case et al. |
| 6,607,882 B1 | 8/2003 | Cox, III et al. |
| 6,610,522 B1 | 8/2003 | Kotewicz et al. |
| 6,689,558 B2 | 2/2004 | Case |
| 6,716,973 B2 | 4/2004 | Baskerville et al. |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,013,219 B2 | 3/2006 | Case et al. |
| 7,045,337 B2 | 5/2006 | Schultz et al. |
| 7,067,650 B1 | 6/2006 | Tanaka |
| 7,070,928 B2 | 7/2006 | Liu et al. |
| 7,078,208 B2 | 7/2006 | Smith et al. |
| 7,083,970 B2 | 8/2006 | Schultz et al. |
| 7,163,824 B2 | 1/2007 | Cox, III et al. |
| 7,192,739 B2 | 3/2007 | Liu et al. |
| 7,223,545 B2 | 5/2007 | Liu et al. |
| 7,354,761 B2 | 4/2008 | Schultz et al. |
| 7,368,275 B2 | 5/2008 | Schultz et al. |
| 7,442,160 B2 | 10/2008 | Liu et al. |
| 7,476,500 B1 | 1/2009 | Liu et al. |
| 7,476,734 B2 | 1/2009 | Liu |
| 7,479,573 B2 | 1/2009 | Chu et al. |
| 7,491,494 B2 | 2/2009 | Liu et al. |
| 7,541,450 B2 | 6/2009 | Liu et al. |
| 7,557,068 B2 | 7/2009 | Liu et al. |
| 7,595,179 B2 | 9/2009 | Chen et al. |
| 7,638,300 B2 | 12/2009 | Schultz et al. |
| 7,670,807 B2 | 3/2010 | Lampson et al. |
| 7,678,554 B2 | 3/2010 | Liu et al. |
| 7,713,721 B2 | 5/2010 | Schultz et al. |
| 7,771,935 B2 | 8/2010 | Liu et al. |
| 7,794,931 B2 | 9/2010 | Breaker et al. |
| 7,807,408 B2 | 10/2010 | Liu et al. |
| 7,851,658 B2 | 12/2010 | Liu et al. |
| 7,915,025 B2 | 3/2011 | Schultz et al. |
| 7,919,277 B2 | 4/2011 | Russell et al. |
| 7,993,672 B2 | 8/2011 | Huang et al. |
| 7,998,904 B2 | 8/2011 | Liu et al. |
| 8,012,739 B2 | 9/2011 | Schultz et al. |
| 8,017,323 B2 | 9/2011 | Liu et al. |
| 8,017,755 B2 | 9/2011 | Liu et al. |
| 8,030,074 B2 | 10/2011 | Schultz et al. |
| 8,067,556 B2 | 11/2011 | Hogrefe et al. |
| 8,114,648 B2 | 2/2012 | Schultz et al. |
| 8,173,364 B2 | 5/2012 | Schultz et al. |
| 8,173,392 B2 | 5/2012 | Schultz et al. |
| 8,183,012 B2 | 5/2012 | Schultz et al. |
| 8,183,178 B2 | 5/2012 | Liu et al. |
| 8,206,914 B2 | 6/2012 | Liu et al. |
| 8,361,725 B2 | 1/2013 | Russell et al. |
| 8,394,604 B2 | 3/2013 | Liu et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,492,082 B2 | 7/2013 | De Franciscis et al. |
| 8,546,553 B2 | 10/2013 | Terns et al. |
| 8,569,256 B2 | 10/2013 | Heyes et al. |
| 8,586,363 B2 | 11/2013 | Voytas et al. |
| 8,680,069 B2 | 3/2014 | de Fougerolles et al. |
| 8,691,729 B2 | 4/2014 | Liu et al. |
| 8,691,750 B2 | 4/2014 | Constien et al. |
| 8,697,359 B1 | 4/2014 | Zhang |
| 8,697,853 B2 | 4/2014 | Voytas et al. |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,822,663 B2 | 9/2014 | Schrum et al. |
| 8,835,148 B2 | 9/2014 | Janulaitis et al. |
| 8,846,578 B2 | 9/2014 | McCray et al. |
| 8,871,445 B2 | 10/2014 | Cong et al. |
| 8,889,418 B2 | 11/2014 | Zhang et al. |
| 8,900,814 B2 | 12/2014 | Yasukawa et al. |
| 8,945,839 B2 | 2/2015 | Zhang |
| 8,975,232 B2 | 3/2015 | Liu et al. |
| 8,993,233 B2 | 3/2015 | Zhang et al. |
| 8,999,641 B2 | 4/2015 | Zhang et al. |
| 9,023,594 B2 | 5/2015 | Liu et al. |
| 9,023,649 B2 | 5/2015 | Mali et al. |
| 9,068,179 B1 | 6/2015 | Liu et al. |
| 9,150,626 B2 | 10/2015 | Liu et al. |
| 9,163,271 B2 | 10/2015 | Schultz et al. |
| 9,163,284 B2 | 10/2015 | Liu et al. |
| 9,181,535 B2 | 11/2015 | Liu et al. |
| 9,200,045 B2 | 12/2015 | Liu et al. |
| 9,221,886 B2 | 12/2015 | Liu et al. |
| 9,228,207 B2 | 1/2016 | Liu et al. |
| 9,234,213 B2 | 1/2016 | Wu |
| 9,243,038 B2 | 1/2016 | Liu et al. |
| 9,267,127 B2 | 2/2016 | Liu et al. |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,394,537 B2 | 7/2016 | Liu et al. |
| 9,434,774 B2 | 9/2016 | Liu et al. |
| 9,458,484 B2 | 10/2016 | Ma et al. |
| 9,512,446 B1 | 12/2016 | Joung et al. |
| 9,526,724 B2 | 12/2016 | Oshlack et al. |
| 9,526,784 B2 | 12/2016 | Liu et al. |
| 9,534,210 B2 | 1/2017 | Park et al. |
| 9,580,698 B1 | 2/2017 | Xu et al. |
| 9,610,322 B2 | 4/2017 | Liu et al. |

(56) References Cited

U.S. PATENT DOCUMENTS

| | | |
|---|---|---|
| 9,637,739 B2 | 5/2017 | Siksnys et al. |
| 9,663,770 B2 | 5/2017 | Rogers et al. |
| 9,737,604 B2 | 8/2017 | Liu et al. |
| 9,738,693 B2 | 8/2017 | Telford et al. |
| 9,753,340 B2 | 9/2017 | Saitou |
| 9,771,574 B2 | 9/2017 | Liu et al. |
| 9,783,791 B2 | 10/2017 | Hogrefe et al. |
| 9,816,093 B1 | 11/2017 | Donohoue et al. |
| 9,840,538 B2 | 12/2017 | Telford et al. |
| 9,840,690 B2 | 12/2017 | Karli et al. |
| 9,840,699 B2 | 12/2017 | Liu et al. |
| 9,840,702 B2 | 12/2017 | Collingwood et al. |
| 9,850,521 B2 | 12/2017 | Braman et al. |
| 9,873,907 B2 | 1/2018 | Zeiner et al. |
| 9,879,270 B2 | 1/2018 | Hittinger et al. |
| 9,914,939 B2 | 3/2018 | Church et al. |
| 9,932,567 B1 | 4/2018 | Xu et al. |
| 9,938,288 B1 | 4/2018 | Kishi et al. |
| 9,944,933 B2 | 4/2018 | Storici et al. |
| 9,982,279 B1 | 5/2018 | Gill et al. |
| 9,999,671 B2 | 6/2018 | Liu et al. |
| 10,011,868 B2 | 7/2018 | Liu et al. |
| 10,053,725 B2 | 8/2018 | Liu et al. |
| 10,059,940 B2 | 8/2018 | Zhong |
| 10,077,453 B2 | 9/2018 | Liu et al. |
| 10,113,163 B2 | 10/2018 | Liu et al. |
| 10,150,955 B2 | 12/2018 | Lambowitz et al. |
| 10,167,457 B2 | 1/2019 | Liu et al. |
| 10,179,911 B2 | 1/2019 | Liu et al. |
| 10,189,831 B2 | 1/2019 | Arrington et al. |
| 10,202,593 B2 | 2/2019 | Liu et al. |
| 10,202,658 B2 | 2/2019 | Parkin et al. |
| 10,227,581 B2 | 3/2019 | Liu et al. |
| 10,323,236 B2 | 6/2019 | Liu et al. |
| 10,336,997 B2 | 7/2019 | Liu et al. |
| 10,358,670 B2 | 7/2019 | Janulaitis et al. |
| 10,392,674 B2 | 8/2019 | Liu et al. |
| 10,407,474 B2 | 9/2019 | Liu et al. |
| 10,407,697 B2 | 9/2019 | Doudna et al. |
| 10,465,176 B2 | 11/2019 | Liu et al. |
| 10,508,298 B2 | 12/2019 | Liu et al. |
| 10,583,201 B2 | 3/2020 | Chen et al. |
| 10,597,679 B2 | 3/2020 | Liu et al. |
| 10,612,011 B2 | 4/2020 | Liu et al. |
| 10,682,410 B2 | 6/2020 | Liu et al. |
| 10,704,062 B2 | 7/2020 | Liu et al. |
| 10,745,677 B2 | 8/2020 | Maianti et al. |
| 10,858,639 B2 | 12/2020 | Liu et al. |
| 10,912,833 B2 | 2/2021 | Liu et al. |
| 10,930,367 B2 | 2/2021 | Zhang et al. |
| 10,947,530 B2 | 3/2021 | Liu et al. |
| 10,954,548 B2 | 3/2021 | Liu et al. |
| 11,046,948 B2 | 6/2021 | Liu et al. |
| 11,053,481 B2 | 7/2021 | Liu et al. |
| 11,124,782 B2 | 9/2021 | Liu et al. |
| 11,214,780 B2 | 1/2022 | Liu et al. |
| 11,268,082 B2 | 3/2022 | Liu et al. |
| 11,299,755 B2 | 4/2022 | Liu et al. |
| 11,306,324 B2 | 4/2022 | Liu et al. |
| 11,319,532 B2 | 5/2022 | Liu et al. |
| 11,447,770 B1 | 9/2022 | Liu et al. |
| 11,542,496 B2 | 1/2023 | Liu et al. |
| 11,542,509 B2 | 1/2023 | Maianti et al. |
| 11,560,566 B2 | 1/2023 | Liu et al. |
| 11,578,343 B2 | 2/2023 | Liu et al. |
| 11,643,652 B2 | 5/2023 | Liu et al. |
| 11,661,590 B2 | 5/2023 | Liu et al. |
| 11,702,651 B2 | 7/2023 | Liu et al. |
| 2003/0082575 A1 | 5/2003 | Schultz et al. |
| 2003/0087817 A1 | 5/2003 | Cox et al. |
| 2003/0096337 A1 | 5/2003 | Hillman et al. |
| 2003/0108885 A1 | 6/2003 | Schultz et al. |
| 2003/0119764 A1 | 6/2003 | Loeb et al. |
| 2003/0167533 A1 | 9/2003 | Yadav et al. |
| 2003/0203480 A1 | 10/2003 | Kovesdi et al. |
| 2004/0003420 A1 | 1/2004 | Kuhn et al. |
| 2004/0115184 A1 | 6/2004 | Smith et al. |
| 2004/0203109 A1 | 10/2004 | Lal et al. |
| 2005/0136429 A1 | 6/2005 | Guarente et al. |
| 2005/0222030 A1 | 10/2005 | Allison |
| 2005/0260626 A1 | 11/2005 | Lorens et al. |
| 2006/0088864 A1 | 4/2006 | Smolke et al. |
| 2006/0104984 A1 | 5/2006 | Littlefield et al. |
| 2006/0246568 A1 | 11/2006 | Honjo et al. |
| 2007/0015238 A1 | 1/2007 | Snyder et al. |
| 2007/0264692 A1 | 11/2007 | Liu et al. |
| 2007/0269817 A1 | 11/2007 | Shapero |
| 2008/0008697 A1 | 1/2008 | Mintier et al. |
| 2008/0051317 A1 | 2/2008 | Church et al. |
| 2008/0124725 A1 | 5/2008 | Barrangou et al. |
| 2008/0182254 A1 | 7/2008 | Hall et al. |
| 2008/0220502 A1 | 9/2008 | Schellenberger et al. |
| 2008/0241917 A1 | 10/2008 | Akita et al. |
| 2008/0268516 A1 | 10/2008 | Perreault et al. |
| 2009/0130718 A1 | 5/2009 | Short |
| 2009/0215878 A1 | 8/2009 | Tan et al. |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0273857 A1 | 10/2010 | Thakker et al. |
| 2010/0305197 A1 | 12/2010 | Che |
| 2010/0316643 A1 | 12/2010 | Eckert et al. |
| 2011/0016540 A1 | 1/2011 | Weinstein et al. |
| 2011/0059160 A1 | 3/2011 | Essner et al. |
| 2011/0059502 A1 | 3/2011 | Chalasani |
| 2011/0104787 A1 | 5/2011 | Church et al. |
| 2011/0177495 A1 | 7/2011 | Liu et al. |
| 2011/0189775 A1 | 8/2011 | Ainley et al. |
| 2011/0189776 A1 | 8/2011 | Terns et al. |
| 2011/0217739 A1 | 9/2011 | Terns et al. |
| 2011/0301073 A1 | 12/2011 | Gregory et al. |
| 2012/0129759 A1 | 5/2012 | Liu et al. |
| 2012/0141523 A1 | 6/2012 | Castado et al. |
| 2012/0244601 A1 | 9/2012 | Bertozzi et al. |
| 2012/0270273 A1 | 10/2012 | Zhang et al. |
| 2012/0322861 A1 | 12/2012 | Byrne et al. |
| 2013/0022980 A1 | 1/2013 | Nelson et al. |
| 2013/0059931 A1 | 3/2013 | Petersen-Mahrt et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0212725 A1 | 8/2013 | Kuhn et al. |
| 2013/0309720 A1 | 11/2013 | Schultz et al. |
| 2013/0344117 A1 | 12/2013 | Mirosevich et al. |
| 2013/0345064 A1 | 12/2013 | Liu et al. |
| 2014/0004280 A1 | 1/2014 | Loomis |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0141094 A1 | 5/2014 | Smyth et al. |
| 2014/0141487 A1 | 5/2014 | Feldman et al. |
| 2014/0179770 A1 | 6/2014 | Zhang et al. |
| 2014/0186843 A1 | 7/2014 | Zhang et al. |
| 2014/0186958 A1 | 7/2014 | Zhang et al. |
| 2014/0201858 A1 | 7/2014 | Ostertag et al. |
| 2014/0234289 A1 | 8/2014 | Liu et al. |
| 2014/0248702 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273234 A1 | 9/2014 | Zhang et al. |
| 2014/0283156 A1 | 9/2014 | Zador et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |

(56) References Cited

U.S. PATENT DOCUMENTS

| | | |
|---|---|---|
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0079681 A1 | 3/2015 | Zhang |
| 2015/0098954 A1 | 4/2015 | Hyde et al. |
| 2015/0118216 A1 | 4/2015 | Liu et al. |
| 2015/0128300 A1 | 5/2015 | Warming et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166983 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0275202 A1 | 10/2015 | Liu et al. |
| 2015/0291965 A1 | 10/2015 | Zhang et al. |
| 2015/0307889 A1 | 10/2015 | Petolino et al. |
| 2015/0315252 A1 | 11/2015 | Haugwitz et al. |
| 2015/0344549 A1 | 12/2015 | Muir et al. |
| 2016/0015682 A2 | 1/2016 | Cawthorne et al. |
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |
| 2016/0040155 A1 | 2/2016 | Maizels et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0115488 A1 | 4/2016 | Zhang et al. |
| 2016/0138046 A1 | 5/2016 | Wu |
| 2016/0153003 A1 | 6/2016 | Joung et al. |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0264934 A1 | 9/2016 | Giallourakis et al. |
| 2016/0272593 A1 | 9/2016 | Ritter et al. |
| 2016/0272965 A1 | 9/2016 | Zhang et al. |
| 2016/0281072 A1 | 9/2016 | Zhang |
| 2016/0298136 A1 | 10/2016 | Chen et al. |
| 2016/0304846 A1* | 10/2016 | Liu .................... C12N 9/78 |
| 2016/0304855 A1 | 10/2016 | Stark et al. |
| 2016/0312304 A1 | 10/2016 | Sorrentino et al. |
| 2016/0319262 A1 | 11/2016 | Doudna et al. |
| 2016/0333389 A1 | 11/2016 | Liu et al. |
| 2016/0340622 A1 | 11/2016 | Abdou |
| 2016/0340662 A1 | 11/2016 | Zhang et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0348096 A1 | 12/2016 | Liu et al. |
| 2016/0350476 A1 | 12/2016 | Quake et al. |
| 2016/0355796 A1 | 12/2016 | Davidson et al. |
| 2016/0369262 A1 | 12/2016 | Reik et al. |
| 2017/0009224 A1 | 1/2017 | Liu et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0037432 A1 | 2/2017 | Donohoue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0073670 A1 | 3/2017 | Nishida et al. |
| 2017/0087224 A1 | 3/2017 | Quake |
| 2017/0087225 A1 | 3/2017 | Quake |
| 2017/0088587 A1 | 3/2017 | Quake |
| 2017/0088828 A1 | 3/2017 | Quake |
| 2017/0107536 A1 | 4/2017 | Zhang et al. |
| 2017/0107560 A1 | 4/2017 | Peter et al. |
| 2017/0114367 A1 | 4/2017 | Hu et al. |
| 2017/0121693 A1 | 5/2017 | Liu et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152528 A1 | 6/2017 | Zhang |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0175142 A1 | 6/2017 | Zhang et al. |
| 2017/0191047 A1 | 7/2017 | Terns et al. |
| 2017/0191078 A1 | 7/2017 | Zhang et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0226522 A1 | 8/2017 | Hu et al. |
| 2017/0233703 A1 | 8/2017 | Xie et al. |
| 2017/0233708 A1 | 8/2017 | Liu et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0275648 A1 | 9/2017 | Barrangou et al. |
| 2017/0275665 A1 | 9/2017 | Silas et al. |
| 2017/0283797 A1 | 10/2017 | Robb et al. |
| 2017/0283831 A1 | 10/2017 | Zhang et al. |
| 2017/0306306 A1 | 10/2017 | Potter et al. |
| 2017/0314016 A1 | 11/2017 | Kim et al. |
| 2017/0362635 A1 | 12/2017 | Chamberlain et al. |
| 2018/0023062 A1 | 1/2018 | Lamb et al. |
| 2018/0064077 A1 | 3/2018 | Dunham et al. |
| 2018/0066258 A1 | 3/2018 | Powell |

(56) References Cited

U.S. PATENT DOCUMENTS

| | | |
|---|---|---|
| 2018/0068062 A1 | 3/2018 | Zhang et al. |
| 2018/0073012 A1 | 3/2018 | Liu et al. |
| 2018/0080051 A1 | 3/2018 | Sheikh et al. |
| 2018/0087046 A1 | 3/2018 | Badran et al. |
| 2018/0100147 A1 | 4/2018 | Yates et al. |
| 2018/0105867 A1 | 4/2018 | Xiao et al. |
| 2018/0119118 A1 | 5/2018 | Lu et al. |
| 2018/0127759 A1 | 5/2018 | Lu et al. |
| 2018/0127780 A1 | 5/2018 | Liu et al. |
| 2018/0155708 A1 | 6/2018 | Church et al. |
| 2018/0155720 A1 | 6/2018 | Donohoue et al. |
| 2018/0163213 A1 | 6/2018 | Aneja et al. |
| 2018/0170984 A1 | 6/2018 | Harris et al. |
| 2018/0179503 A1 | 6/2018 | Maianti et al. |
| 2018/0179547 A1 | 6/2018 | Zhang et al. |
| 2018/0201921 A1 | 7/2018 | Malcolm |
| 2018/0230464 A1 | 8/2018 | Zhong |
| 2018/0230471 A1 | 8/2018 | Storici et al. |
| 2018/0236081 A1 | 8/2018 | Liu et al. |
| 2018/0237787 A1 | 8/2018 | Maianti et al. |
| 2018/0245066 A1 | 8/2018 | Yao et al. |
| 2018/0245075 A1 | 8/2018 | Khalil et al. |
| 2018/0258418 A1 | 9/2018 | Kim |
| 2018/0265864 A1 | 9/2018 | Li et al. |
| 2018/0273939 A1 | 9/2018 | Yu et al. |
| 2018/0282722 A1 | 10/2018 | Jakimo et al. |
| 2018/0298391 A1 | 10/2018 | Jakimo et al. |
| 2018/0305688 A1 | 10/2018 | Zhong |
| 2018/0305704 A1 | 10/2018 | Zhang |
| 2018/0312822 A1 | 11/2018 | Lee et al. |
| 2018/0312825 A1 | 11/2018 | Liu et al. |
| 2018/0312828 A1 | 11/2018 | Liu et al. |
| 2018/0312835 A1 | 11/2018 | Yao et al. |
| 2018/0327756 A1 | 11/2018 | Zhang et al. |
| 2018/0346927 A1 | 12/2018 | Doudna et al. |
| 2018/0371497 A1 | 12/2018 | Gill et al. |
| 2019/0010481 A1 | 1/2019 | Joung et al. |
| 2019/0055543 A1 | 2/2019 | Tran et al. |
| 2019/0055549 A1 | 2/2019 | Capurso et al. |
| 2019/0062734 A1 | 2/2019 | Cotta-Ramusino et al. |
| 2019/0093099 A1 | 3/2019 | Liu et al. |
| 2019/0185883 A1 | 6/2019 | Liu et al. |
| 2019/0218547 A1 | 7/2019 | Lee et al. |
| 2019/0225955 A1 | 7/2019 | Liu et al. |
| 2019/0233847 A1 | 8/2019 | Savage et al. |
| 2019/0241633 A1 | 8/2019 | Fotin-Mleczek et al. |
| 2019/0256842 A1 | 8/2019 | Liu et al. |
| 2019/0264202 A1 | 8/2019 | Church et al. |
| 2019/0276816 A1 | 9/2019 | Liu et al. |
| 2019/0309290 A1 | 10/2019 | Neuteboom et al. |
| 2019/0322992 A1 | 10/2019 | Liu et al. |
| 2019/0330619 A1 | 10/2019 | Smith et al. |
| 2019/0352632 A1 | 11/2019 | Liu et al. |
| 2019/0367891 A1 | 12/2019 | Liu et al. |
| 2020/0010818 A1 | 1/2020 | Liu et al. |
| 2020/0010835 A1 | 1/2020 | Maianti et al. |
| 2020/0063127 A1 | 2/2020 | Lu et al. |
| 2020/0071722 A1 | 3/2020 | Liu et al. |
| 2020/0172931 A1 | 6/2020 | Liu et al. |
| 2020/0181619 A1 | 6/2020 | Tang et al. |
| 2020/0190493 A1 | 6/2020 | Liu et al. |
| 2020/0255868 A1 | 8/2020 | Liu et al. |
| 2020/0277587 A1 | 9/2020 | Liu et al. |
| 2020/0323984 A1 | 10/2020 | Liu et al. |
| 2020/0399619 A1 | 12/2020 | Maianti et al. |
| 2020/0399626 A1 | 12/2020 | Liu et al. |
| 2021/0054416 A1 | 2/2021 | Liu et al. |
| 2021/0196809 A1 | 7/2021 | Maianti et al. |
| 2021/0198330 A1 | 7/2021 | Liu et al. |
| 2021/0214698 A1 | 7/2021 | Liu et al. |
| 2021/0230577 A1 | 7/2021 | Liu et al. |
| 2021/0254127 A1 | 8/2021 | Liu et al. |
| 2021/0315994 A1 | 10/2021 | Liu et al. |
| 2021/0317440 A1 | 10/2021 | Liu et al. |
| 2022/0033785 A1 | 2/2022 | Liu et al. |
| 2022/0119785 A1 | 4/2022 | Liu et al. |
| 2022/0170013 A1 | 6/2022 | Liu et al. |
| 2022/0177877 A1 | 6/2022 | Church et al. |
| 2022/0204975 A1 | 6/2022 | Liu et al. |
| 2022/0213507 A1 | 7/2022 | Liu et al. |
| 2022/0220462 A1 | 7/2022 | Liu et al. |
| 2022/0238182 A1 | 7/2022 | Shen et al. |
| 2022/0249697 A1 | 8/2022 | Liu et al. |
| 2022/0282275 A1 | 9/2022 | Liu et al. |
| 2022/0290115 A1 | 9/2022 | Liu et al. |
| 2022/0307001 A1 | 9/2022 | Liu et al. |
| 2022/0307003 A1 | 9/2022 | Liu et al. |
| 2022/0315906 A1 | 10/2022 | Liu et al. |
| 2022/0356469 A1 | 11/2022 | Liu et al. |
| 2022/0380740 A1 | 12/2022 | Liu et al. |
| 2022/0389395 A1 | 12/2022 | Liu et al. |
| 2023/0002745 A1 | 1/2023 | Liu et al. |
| 2023/0021641 A1 | 1/2023 | Liu et al. |
| 2023/0056852 A1 | 2/2023 | Liu et al. |
| 2023/0058176 A1 | 2/2023 | Liu et al. |
| 2023/0078265 A1 | 3/2023 | Liu et al. |
| 2023/0086199 A1 | 3/2023 | Liu et al. |
| 2023/0090221 A1 | 3/2023 | Liu et al. |
| 2023/0108687 A1 | 4/2023 | Liu et al. |
| 2023/0123669 A1 | 4/2023 | Liu et al. |
| 2023/0127008 A1 | 4/2023 | Liu et al. |
| 2023/0159913 A1 | 5/2023 | Liu et al. |
| 2023/0193295 A1 | 6/2023 | Maianti et al. |

FOREIGN PATENT DOCUMENTS

| | | |
|---|---|---|
| AU | 2015252023 A1 | 11/2015 |
| AU | 2015101792 A4 | 1/2016 |
| BR | 112015013786 A2 | 7/2017 |
| CA | 2894668 A1 | 6/2014 |
| CA | 2894681 A1 | 6/2014 |
| CA | 2894684 A1 | 6/2014 |
| CA | 2852593 A1 | 11/2015 |
| CN | 1069962 A | 3/1993 |
| CN | 101460619 A | 6/2009 |
| CN | 101873862 A | 10/2010 |
| CN | 102892777 A | 1/2013 |
| CN | 103224947 A | 7/2013 |
| CN | 103233028 A | 8/2013 |
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103088008 A | 8/2014 |
| CN | 103981211 A | 8/2014 |
| CN | 103981212 A | 8/2014 |
| CN | 104004778 A | 8/2014 |
| CN | 104004782 A | 8/2014 |
| CN | 104017821 A | 9/2014 |
| CN | 104109687 A | 10/2014 |
| CN | 104178461 A | 12/2014 |
| CN | 104342457 A | 2/2015 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104561095 A | 4/2015 |
| CN | 104593418 A | 5/2015 |
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |
| CN | 104651401 A | 5/2015 |
| CN | 104673816 A | 6/2015 |
| CN | 104725626 A | 6/2015 |

(56) References Cited

FOREIGN PATENT DOCUMENTS

| | | |
|---|---|---|
| CN | 104726449 A | 6/2015 |
| CN | 104726494 A | 6/2015 |
| CN | 104745626 A | 7/2015 |
| CN | 104762321 A | 7/2015 |
| CN | 104805078 A | 7/2015 |
| CN | 104805099 A | 7/2015 |
| CN | 104805118 A | 7/2015 |
| CN | 104846010 A | 8/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105121648 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 A | 5/2016 |
| CN | 105567734 A | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |
| CN | 105647968 A | 6/2016 |
| CN | 105647969 A | 6/2016 |
| CN | 105671070 A | 6/2016 |
| CN | 105671083 A | 6/2016 |
| CN | 105695485 A | 6/2016 |
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105934516 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011104 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244557 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |

(56) References Cited

FOREIGN PATENT DOCUMENTS

| | | |
|---|---|---|
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480080 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |
| CN | 107177591 A | 9/2017 |
| CN | 107177595 A | 9/2017 |
| CN | 107177625 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |
| CN | 107557390 A | 1/2018 |
| CN | 107557393 A | 1/2018 |
| CN | 107557394 A | 1/2018 |
| CN | 107557455 A | 1/2018 |
| CN | 107574179 A | 1/2018 |
| CN | 107586777 A | 1/2018 |
| CN | 107586779 A | 1/2018 |
| CN | 107604003 A | 1/2018 |
| CN | 107619829 A | 1/2018 |
| CN | 107619837 A | 1/2018 |
| CN | 107630006 A | 1/2018 |
| CN | 107630041 A | 1/2018 |
| CN | 107630042 A | 1/2018 |
| CN | 107630043 A | 1/2018 |
| CN | 107641631 A | 1/2018 |

(56) References Cited

FOREIGN PATENT DOCUMENTS

| | | |
|---|---|---|
| CN | 107653256 A | 2/2018 |
| CN | 107686848 A | 2/2018 |
| CN | 206970581 U | 2/2018 |
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| CN | 107974466 A | 5/2018 |
| CN | 107988229 A | 5/2018 |
| CN | 107988246 A | 5/2018 |
| CN | 107988256 A | 5/2018 |
| CN | 107988268 A | 5/2018 |
| CN | 108018316 A | 5/2018 |
| CN | 108034656 A | 5/2018 |
| CN | 108048466 A | 5/2018 |
| CN | 108102940 A | 6/2018 |
| CN | 108103090 A | 6/2018 |
| CN | 108103092 A | 6/2018 |
| CN | 108103098 A | 6/2018 |
| CN | 108103586 A | 6/2018 |
| CN | 108148835 A | 6/2018 |
| CN | 108148837 A | 6/2018 |
| CN | 108148873 A | 6/2018 |
| CN | 108192956 A | 6/2018 |
| CN | 108251423 A | 7/2018 |
| CN | 108251451 A | 7/2018 |
| CN | 108251452 A | 7/2018 |
| CN | 108342480 A | 7/2018 |
| CN | 108359691 A | 8/2018 |
| CN | 108359712 A | 8/2018 |
| CN | 108384784 A | 8/2018 |
| CN | 108396027 A | 8/2018 |
| CN | 108410877 A | 8/2018 |
| CN | 108410906 A | 8/2018 |
| CN | 108410907 A | 8/2018 |
| CN | 108410911 A | 8/2018 |
| CN | 108424931 A | 8/2018 |
| CN | 108441519 A | 8/2018 |
| CN | 108441520 A | 8/2018 |
| CN | 108486108 A | 9/2018 |
| CN | 108486111 A | 9/2018 |
| CN | 108486145 A | 9/2018 |
| CN | 108486146 A | 9/2018 |
| CN | 108486154 A | 9/2018 |
| CN | 108486159 A | 9/2018 |
| CN | 108486234 A | 9/2018 |
| CN | 108504657 A | 9/2018 |
| CN | 108504685 A | 9/2018 |
| CN | 108504693 A | 9/2018 |
| CN | 108546712 A | 9/2018 |
| CN | 108546717 A | 9/2018 |
| CN | 108546718 A | 9/2018 |
| CN | 108559730 A | 9/2018 |
| CN | 108559732 A | 9/2018 |
| CN | 108559745 A | 9/2018 |
| CN | 108559760 A | 9/2018 |
| CN | 108570479 A | 9/2018 |
| CN | 108588071 A | 9/2018 |
| CN | 108588123 A | 9/2018 |
| CN | 108588128 A | 9/2018 |
| CN | 108588182 A | 9/2018 |
| CN | 108610399 A | 10/2018 |
| CN | 108611364 A | 10/2018 |
| CN | 108624622 A | 10/2018 |
| CN | 108642053 A | 10/2018 |
| CN | 108642055 A | 10/2018 |
| CN | 108642077 A | 10/2018 |
| CN | 108642078 A | 10/2018 |
| CN | 108642090 A | 10/2018 |
| CN | 108690844 A | 10/2018 |
| CN | 108707604 A | 10/2018 |
| CN | 108707620 A | 10/2018 |
| CN | 108707621 A | 10/2018 |
| CN | 108707628 A | 10/2018 |
| CN | 108707629 A | 10/2018 |
| CN | 108715850 A | 10/2018 |
| CN | 108728476 A | 11/2018 |
| CN | 108728486 A | 11/2018 |
| CN | 108753772 A | 11/2018 |
| CN | 108753783 A | 11/2018 |
| CN | 108753813 A | 11/2018 |
| CN | 108753817 A | 11/2018 |
| CN | 108753832 A | 11/2018 |
| CN | 108753835 A | 11/2018 |
| CN | 108753836 A | 11/2018 |
| CN | 108795902 A | 11/2018 |
| CN | 108822217 A | 11/2018 |
| CN | 108823248 A | 11/2018 |
| CN | 108823249 A | 11/2018 |
| CN | 108823291 A | 11/2018 |
| CN | 108841845 A | 11/2018 |
| CN | 108853133 A | 11/2018 |
| CN | 108866093 A | 11/2018 |
| CN | 108893529 A | 11/2018 |
| CN | 108913664 A | 11/2018 |
| CN | 108913691 A | 11/2018 |
| CN | 108913714 A | 11/2018 |
| CN | 108913717 A | 11/2018 |
| CN | 208034188 U | 11/2018 |
| CN | 109517841 A | 3/2019 |
| EP | 0264166 A1 | 4/1988 |
| EP | 0321201 B2 | 6/1989 |
| EP | 0519463 A1 | 12/1992 |
| EP | 2604255 A1 | 6/2013 |
| EP | 2840140 A1 | 2/2015 |
| EP | 2877490 A2 | 6/2015 |
| EP | 2966170 A1 | 1/2016 |
| EP | 3009511 A2 | 4/2016 |
| EP | 3031921 A1 | 6/2016 |
| EP | 3045537 A1 | 7/2016 |
| EP | 3115457 A | 1/2017 |
| EP | 3144390 A1 | 3/2017 |
| EP | 3199632 A1 | 8/2017 |
| EP | 3216867 A1 | 9/2017 |
| EP | 3252160 A1 | 12/2017 |
| EP | 3450553 B1 | 12/2019 |
| ES | 2740248 T3 | 2/2020 |
| GB | 2528177 A | 1/2016 |
| GB | 2531454 A1 | 4/2016 |
| GB | 2542653 A | 3/2017 |
| HK | 1208045 A1 | 2/2016 |
| JP | 2007-501626 A | 2/2007 |
| JP | 2008-515405 A | 5/2008 |
| JP | 2010-033344 A | 2/2010 |
| JP | 2010-535744 A | 11/2010 |
| JP | 2010-539929 A | 12/2010 |
| JP | 2011-081011 A | 4/2011 |
| JP | 2011-523353 A | 8/2011 |
| JP | 2012-525146 A | 10/2012 |
| JP | 2012-210172 A | 11/2012 |
| JP | 2012-531909 A | 12/2012 |
| JP | 2015-523856 A | 8/2015 |
| JP | 2015-532654 A | 11/2015 |

(56) References Cited

FOREIGN PATENT DOCUMENTS

| | | |
|---|---|---|
| JP | 2016-525888 A | 9/2016 |
| JP | 2016-534132 A | 11/2016 |
| JP | 2017-500035 A | 1/2017 |
| JP | 2018-521045 A | 8/2018 |
| JP | 6629734 B2 | 1/2020 |
| JP | 6633524 B2 | 1/2020 |
| KR | 101584933 B1 | 1/2016 |
| KR | 2016-0050069 A | 5/2016 |
| KR | 20160133380 A | 11/2016 |
| KR | 20170037025 A | 4/2017 |
| KR | 20170037028 A | 4/2017 |
| KR | 101748575 B1 | 6/2017 |
| KR | 20170128137 A | 11/2017 |
| KR | 2018-0022465 A | 3/2018 |
| RU | 2016104674 A | 8/2017 |
| RU | 2634395 C1 | 10/2017 |
| RU | 2652899 C1 | 5/2018 |
| RU | 2015128057 A | 3/2019 |
| RU | 2015128098 A | 3/2019 |
| RU | 2687451 C1 | 5/2019 |
| RU | 2019112514 A | 6/2019 |
| RU | 2019127300 A | 9/2019 |
| RU | 2701850 C2 | 10/2019 |
| SG | 10201707569 Y | 10/2017 |
| SG | 10201710486 | 1/2018 |
| SG | 10201710487 | 1/2018 |
| SG | 10201710488 T | 1/2018 |
| TW | I608100 B | 12/2017 |
| TW | 2018-29773 A | 8/2018 |
| WO | WO 1990/002809 | 3/1990 |
| WO | WO 1991/003162 A1 | 3/1991 |
| WO | WO 1991/016024 A1 | 10/1991 |
| WO | WO 1991/017271 A1 | 11/1991 |
| WO | WO 1991/017424 A1 | 11/1991 |
| WO | WO 1992/006188 A2 | 4/1992 |
| WO | WO 1992/006200 A1 | 4/1992 |
| WO | WO 1992/007065 A1 | 4/1992 |
| WO | WO 1993/015187 A1 | 8/1993 |
| WO | WO 1993/024641 A2 | 12/1993 |
| WO | WO 1994/018316 A2 | 8/1994 |
| WO | WO 1994/026877 A1 | 11/1994 |
| WO | WO 1996/004403 A1 | 2/1996 |
| WO | WO 1996/010640 A1 | 4/1996 |
| WO | WO 1998/032845 A1 | 7/1998 |
| WO | WO 2001/036452 A2 | 5/2001 |
| WO | WO 2001/038547 A2 | 5/2001 |
| WO | WO 2002/059296 A2 | 8/2002 |
| WO | WO 2002/068676 A2 | 9/2002 |
| WO | WO 2002/103028 A2 | 12/2002 |
| WO | WO 2004/007684 A2 | 1/2004 |
| WO | WO 2005/014791 A2 | 2/2005 |
| WO | WO 2005/019415 A2 | 3/2005 |
| WO | WO 2006/002547 A1 | 1/2006 |
| WO | WO 2006/042112 A2 | 4/2006 |
| WO | WO 2007/025097 A2 | 3/2007 |
| WO | WO 2007/037444 A1 | 4/2007 |
| WO | WO 2007/066923 A1 | 6/2007 |
| WO | WO 2007/136815 A2 | 11/2007 |
| WO | WO 2007/143574 A1 | 12/2007 |
| WO | WO 2008/005529 A2 | 1/2008 |
| WO | WO 2008/108989 A2 | 9/2008 |
| WO | WO 2009/002418 A2 | 12/2008 |
| WO | WO 2009/098290 A1 | 8/2009 |
| WO | WO 2009/134808 A2 | 11/2009 |
| WO | WO 2010/011961 A2 | 1/2010 |
| WO | WO 2010/012902 A1 | 2/2010 |
| WO | WO 2010/028347 A2 | 3/2010 |
| WO | WO 2010/054108 A2 | 5/2010 |
| WO | WO 2010/054154 A2 | 5/2010 |
| WO | WO 2010/068289 A2 | 6/2010 |
| WO | WO 2010/075424 A2 | 7/2010 |
| WO | WO 2010/102257 A2 | 9/2010 |
| WO | WO 2010/104749 A2 | 9/2010 |
| WO | WO 2010/129019 A2 | 11/2010 |
| WO | WO 2010/129023 A2 | 11/2010 |
| WO | WO 2010/132092 A2 | 11/2010 |
| WO | WO 2010/144150 A2 | 12/2010 |
| WO | WO 2011/002503 A1 | 1/2011 |
| WO | WO 2011/017293 A2 | 2/2011 |
| WO | WO 2011/053868 A1 | 5/2011 |
| WO | WO 2011/053982 A2 | 5/2011 |
| WO | WO 2011/068810 A1 | 6/2011 |
| WO | WO 2011/075627 A1 | 6/2011 |
| WO | WO 2011/091311 A2 | 7/2011 |
| WO | WO 2011/091396 A1 | 7/2011 |
| WO | WO 2011/109031 A1 | 9/2011 |
| WO | WO 2011/143124 A2 | 11/2011 |
| WO | WO 2011/147590 A2 | 12/2011 |
| WO | WO 2011/159369 A1 | 12/2011 |
| WO | WO 2012/054726 A1 | 4/2012 |
| WO | WO 2012/065043 A2 | 5/2012 |
| WO | WO 2012/088381 A2 | 6/2012 |
| WO | WO 2012/125445 A2 | 9/2012 |
| WO | WO 2012/138927 A2 | 10/2012 |
| WO | WO 2012/149470 A1 | 11/2012 |
| WO | WO 2012/158985 A2 | 11/2012 |
| WO | WO 2012/158986 A2 | 11/2012 |
| WO | WO 2012/164565 A1 | 12/2012 |
| WO | WO 2012/170930 A1 | 12/2012 |
| WO | WO 2013/012674 A1 | 1/2013 |
| WO | WO 2013/013105 A1 | 1/2013 |
| WO | WO 2013/039857 A1 | 3/2013 |
| WO | WO 2013/039861 A2 | 3/2013 |
| WO | WO 2013/045632 A1 | 4/2013 |
| WO | WO 2013/047844 A1 | 4/2013 |
| WO | WO 2013/066438 A2 | 5/2013 |
| WO | WO 2013/086441 A2 | 6/2013 |
| WO | WO 2013/086444 A2 | 6/2013 |
| WO | WO 2013/098244 A1 | 7/2013 |
| WO | WO 2013/119602 A1 | 8/2013 |
| WO | WO 2013/126794 A1 | 8/2013 |
| WO | WO 2013/130824 A1 | 9/2013 |
| WO | WO 2013/141680 A1 | 9/2013 |
| WO | WO 2013/142578 A2 | 9/2013 |
| WO | WO 2013/152359 A1 | 10/2013 |
| WO | WO 2013/160230 A1 | 10/2013 |
| WO | WO 2013/166315 A1 | 11/2013 |
| WO | WO 2013/169398 A2 | 11/2013 |
| WO | WO 2013/169802 A1 | 11/2013 |
| WO | WO 2013/176772 A2 | 11/2013 |
| WO | WO 2013/176915 A1 | 11/2013 |
| WO | WO 2013/176916 A1 | 11/2013 |
| WO | WO 2013/181440 A1 | 12/2013 |
| WO | WO 2013/186754 A2 | 12/2013 |
| WO | WO 2013/188037 A2 | 12/2013 |
| WO | WO 2013/188522 A2 | 12/2013 |
| WO | WO 2013/188638 A2 | 12/2013 |
| WO | WO 2013/192278 A1 | 12/2013 |
| WO | WO 2013/142378 A9 | 1/2014 |
| WO | WO 2014/004336 A2 | 1/2014 |
| WO | WO 2014/005042 A2 | 1/2014 |
| WO | WO 2014/011237 A1 | 1/2014 |
| WO | WO 2014/011901 A2 | 1/2014 |
| WO | WO 2014/018423 A2 | 1/2014 |
| WO | WO 2014/020608 A1 | 2/2014 |
| WO | WO 2014/022120 A1 | 2/2014 |
| WO | WO 2014/022702 A2 | 2/2014 |
| WO | WO 2014/036219 A2 | 3/2014 |
| WO | WO 2014/039513 A2 | 3/2014 |
| WO | WO 2014/039523 A1 | 3/2014 |
| WO | WO 2014/039585 A2 | 3/2014 |
| WO | WO 2014/039684 A1 | 3/2014 |
| WO | WO 2014/039692 A2 | 3/2014 |
| WO | WO 2014/039702 A2 | 3/2014 |
| WO | WO 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/055782 A1 | 4/2014 |
| WO | WO 2014/059173 A2 | 4/2014 |
| WO | WO 2014/059255 A1 | 4/2014 |
| WO | WO 2014/065596 A1 | 5/2014 |
| WO | WO 2014/066505 A1 | 5/2014 |

(56) References Cited

FOREIGN PATENT DOCUMENTS

| | | |
|---|---|---|
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A2 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/093736 A1 | 6/2014 |
| WO | WO 2014/093768 A1 | 6/2014 |
| WO | WO 2014/093852 A1 | 6/2014 |
| WO | WO 2014/096972 A2 | 6/2014 |
| WO | WO 2014/099744 A1 | 6/2014 |
| WO | WO 2014/099750 A2 | 6/2014 |
| WO | WO 2014/104878 A1 | 7/2014 |
| WO | WO 2014/110006 A1 | 7/2014 |
| WO | WO 2014/110552 A1 | 7/2014 |
| WO | WO 2014/113493 A1 | 7/2014 |
| WO | WO 2014/123967 A2 | 8/2014 |
| WO | WO 2014/124226 A1 | 8/2014 |
| WO | WO 2014/125668 A1 | 8/2014 |
| WO | WO 2014/127287 A1 | 8/2014 |
| WO | WO 2014/128324 A1 | 8/2014 |
| WO | WO 2014/128659 A1 | 8/2014 |
| WO | WO 2014/130706 A1 | 8/2014 |
| WO | WO 2014/130955 A1 | 8/2014 |
| WO | WO 2014/131833 A1 | 9/2014 |
| WO | WO 2014/138379 A1 | 9/2014 |
| WO | WO 2014/143381 A1 | 9/2014 |
| WO | WO 2014/144094 A1 | 9/2014 |
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/144951 A1 | 9/2014 |
| WO | WO 2014/145599 A2 | 9/2014 |
| WO | WO 2014/145736 A2 | 9/2014 |
| WO | WO 2014/150624 A1 | 9/2014 |
| WO | WO 2014/152432 A2 | 9/2014 |
| WO | WO 2014/152940 A1 | 9/2014 |
| WO | WO 2014/153118 A1 | 9/2014 |
| WO | WO 2014/153470 A2 | 9/2014 |
| WO | WO 2014/158593 A1 | 10/2014 |
| WO | WO 2014/161821 A1 | 10/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165612 A2 | 10/2014 |
| WO | WO 2014/165707 A2 | 10/2014 |
| WO | WO 2014/165825 A2 | 10/2014 |
| WO | WO 2014/172458 A1 | 10/2014 |
| WO | WO 2014/172470 A2 | 10/2014 |
| WO | WO 2014/172489 A2 | 10/2014 |
| WO | WO 2014/173955 A1 | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/193583 A2 | 12/2014 |
| WO | WO 2014/194190 A1 | 12/2014 |
| WO | WO 2014/197568 A2 | 12/2014 |
| WO | WO 2014/197748 A2 | 12/2014 |
| WO | WO 2014/199358 A1 | 12/2014 |
| WO | WO 2014/200659 A1 | 12/2014 |
| WO | WO 2014/201015 A2 | 12/2014 |
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2014/205192 A2 | 12/2014 |
| WO | WO 2014/207043 A1 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006437 A1 | 1/2015 |
| WO | WO 2015/006498 A2 | 1/2015 |
| WO | WO 2015/006747 A2 | 1/2015 |
| WO | WO 2015/007194 A1 | 1/2015 |
| WO | WO 2015/010114 A1 | 1/2015 |
| WO | WO 2015/011483 A1 | 1/2015 |
| WO | WO 2015/013583 A2 | 1/2015 |
| WO | WO 2015/017866 A1 | 2/2015 |
| WO | WO 2015/018503 A2 | 2/2015 |
| WO | WO 2015/021353 A1 | 2/2015 |
| WO | WO 2015/021426 A1 | 2/2015 |
| WO | WO 2015/021990 A1 | 2/2015 |
| WO | WO 2015/024017 A2 | 2/2015 |
| WO | WO 2015/024986 A1 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/028969 A2 | 3/2015 |
| WO | WO 2015/030881 A1 | 3/2015 |
| WO | WO 2015/031619 A1 | 3/2015 |
| WO | WO 2015/031775 A1 | 3/2015 |
| WO | WO 2015/032494 A2 | 3/2015 |
| WO | WO 2015/033293 A1 | 3/2015 |
| WO | WO 2015/034872 A2 | 3/2015 |
| WO | WO 2015/034885 A1 | 3/2015 |
| WO | WO 2015/035136 A2 | 3/2015 |
| WO | WO 2015/035139 A2 | 3/2015 |
| WO | WO 2015/035162 A2 | 3/2015 |
| WO | WO 2015/040075 A1 | 3/2015 |
| WO | WO 2015/040402 A1 | 3/2015 |
| WO | WO 2015/042393 A2 | 3/2015 |
| WO | WO 2015/042585 A1 | 3/2015 |
| WO | WO 2015/048577 A2 | 4/2015 |
| WO | WO 2015/048690 A1 | 4/2015 |
| WO | WO 2015/048707 A2 | 4/2015 |
| WO | WO 2015/048801 A2 | 4/2015 |
| WO | WO 2015/049897 A1 | 4/2015 |
| WO | WO 2015/051191 A1 | 4/2015 |
| WO | WO 2015/052133 A1 | 4/2015 |
| WO | WO 2015/052231 A2 | 4/2015 |
| WO | WO 2015/052335 A1 | 4/2015 |
| WO | WO 2015/053995 A1 | 4/2015 |

(56) References Cited

FOREIGN PATENT DOCUMENTS

| | | |
|---|---|---|
| WO | WO 2015/054253 A1 | 4/2015 |
| WO | WO 2015/054315 A1 | 4/2015 |
| WO | WO 2015/057671 A1 | 4/2015 |
| WO | WO 2015/057834 A1 | 4/2015 |
| WO | WO 2015/057852 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066634 A2 | 5/2015 |
| WO | WO 2015/066636 A2 | 5/2015 |
| WO | WO 2015/066637 A1 | 5/2015 |
| WO | WO 2015/066638 A2 | 5/2015 |
| WO | WO 2015/066643 A1 | 5/2015 |
| WO | WO 2015/069682 A2 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |
| WO | WO 2015/073867 A1 | 5/2015 |
| WO | WO 2015/073990 A1 | 5/2015 |
| WO | WO 2015/075056 A1 | 5/2015 |
| WO | WO 2015/075154 A2 | 5/2015 |
| WO | WO 2015/075175 A1 | 5/2015 |
| WO | WO 2015/075195 A1 | 5/2015 |
| WO | WO 2015/075557 A2 | 5/2015 |
| WO | WO 2015/077058 A2 | 5/2015 |
| WO | WO 2015/077290 A2 | 5/2015 |
| WO | WO 2015/077318 A1 | 5/2015 |
| WO | WO 2015/079056 A1 | 6/2015 |
| WO | WO 2015/079057 A2 | 6/2015 |
| WO | WO 2015/086795 A1 | 6/2015 |
| WO | WO 2015/086798 A2 | 6/2015 |
| WO | WO 2015/088643 A1 | 6/2015 |
| WO | WO 2015/089046 A1 | 6/2015 |
| WO | WO 2015/089077 A2 | 6/2015 |
| WO | WO 2015/089277 A1 | 6/2015 |
| WO | WO 2015/089351 A1 | 6/2015 |
| WO | WO 2015/089354 A1 | 6/2015 |
| WO | WO 2015/089364 A1 | 6/2015 |
| WO | WO 2015/089406 A1 | 6/2015 |
| WO | WO 2015/089419 A2 | 6/2015 |
| WO | WO 2015/089427 A1 | 6/2015 |
| WO | WO 2015/089462 A1 | 6/2015 |
| WO | WO 2015/089465 A1 | 6/2015 |
| WO | WO 2015/089473 A1 | 6/2015 |
| WO | WO 2015/089486 A2 | 6/2015 |
| WO | WO 2015/095804 A1 | 6/2015 |
| WO | WO 2015/099850 A1 | 7/2015 |
| WO | WO 2015/100929 A1 | 7/2015 |
| WO | WO 2015/103057 A1 | 7/2015 |
| WO | WO 2015/103153 A1 | 7/2015 |
| WO | WO 2015/105928 A1 | 7/2015 |
| WO | WO 2015/108993 A1 | 7/2015 |
| WO | WO 2015/109752 A1 | 7/2015 |
| WO | WO 2015/110474 A1 | 7/2015 |
| WO | WO 2015/112790 A2 | 7/2015 |
| WO | WO 2015/112896 A2 | 7/2015 |
| WO | WO 2015/113063 A1 | 7/2015 |
| WO | WO 2015/114365 A1 | 8/2015 |
| WO | WO 2015/115903 A1 | 8/2015 |
| WO | WO 2015/116686 A1 | 8/2015 |
| WO | WO 2015/116969 A2 | 8/2015 |
| WO | WO 2015/117021 A1 | 8/2015 |
| WO | WO 2015/117041 A1 | 8/2015 |
| WO | WO 2015/117081 A2 | 8/2015 |
| WO | WO 2015/118156 A1 | 8/2015 |
| WO | WO 2015/119941 A2 | 8/2015 |
| WO | WO 2015/121454 A1 | 8/2015 |
| WO | WO 2015/122967 A1 | 8/2015 |
| WO | WO 2015/123339 A1 | 8/2015 |
| WO | WO 2015/124715 A1 | 8/2015 |
| WO | WO 2015/124718 A1 | 8/2015 |
| WO | WO 2015/126927 A2 | 8/2015 |
| WO | WO 2015/127428 A1 | 8/2015 |
| WO | WO 2015/127439 A1 | 8/2015 |
| WO | WO 2015/129686 A1 | 9/2015 |
| WO | WO 2015/131101 A1 | 9/2015 |
| WO | WO 2015/133554 A1 | 9/2015 |
| WO | WO 2015/134121 A2 | 9/2015 |
| WO | WO 2015/134812 A1 | 9/2015 |
| WO | WO 2015/136001 A1 | 9/2015 |
| WO | WO 2015/138510 A1 | 9/2015 |
| WO | WO 2015/138739 A2 | 9/2015 |
| WO | WO 2015/138855 A1 | 9/2015 |
| WO | WO 2015/138870 A2 | 9/2015 |
| WO | WO 2015/139008 A1 | 9/2015 |
| WO | WO 2015/139139 A1 | 9/2015 |
| WO | WO 2015/143046 A2 | 9/2015 |
| WO | WO 2015/143177 A1 | 9/2015 |
| WO | WO 2015/145417 A1 | 10/2015 |
| WO | WO 2015/148431 A1 | 10/2015 |
| WO | WO 2015/148670 A1 | 10/2015 |
| WO | WO 2015/148680 A1 | 10/2015 |
| WO | WO 2015/148760 A1 | 10/2015 |
| WO | WO 2015/148761 A1 | 10/2015 |
| WO | WO 2015/148860 A1 | 10/2015 |
| WO | WO 2015/148863 A2 | 10/2015 |
| WO | WO 2015/153760 A2 | 10/2015 |
| WO | WO 2015/153780 A1 | 10/2015 |
| WO | WO 2015/153789 A1 | 10/2015 |
| WO | WO 2015/153791 A1 | 10/2015 |
| WO | WO 2015/153889 A2 | 10/2015 |
| WO | WO 2015/153940 A1 | 10/2015 |
| WO | WO 2015/155341 A1 | 10/2015 |
| WO | WO 2015/155686 A2 | 10/2015 |
| WO | WO 2015/157070 A2 | 10/2015 |
| WO | WO 2015/157534 A1 | 10/2015 |
| WO | WO 2015/159068 A1 | 10/2015 |
| WO | WO 2015/159086 A1 | 10/2015 |
| WO | WO 2015/159087 A1 | 10/2015 |
| WO | WO 2015/160683 A1 | 10/2015 |
| WO | WO 2015/161276 A2 | 10/2015 |
| WO | WO 2015/163733 A1 | 10/2015 |
| WO | WO 2015/164740 A1 | 10/2015 |
| WO | WO 2015/164748 A1 | 10/2015 |
| WO | WO 2015/165274 A1 | 11/2015 |
| WO | WO 2015/165275 A1 | 11/2015 |
| WO | WO 2015/165276 A1 | 11/2015 |
| WO | WO 2015/166272 A2 | 11/2015 |
| WO | WO 2015/167766 A1 | 11/2015 |
| WO | WO 2015/167956 A1 | 11/2015 |
| WO | WO 2015/168125 A1 | 11/2015 |
| WO | WO 2015/168158 A1 | 11/2015 |
| WO | WO 2015/168404 A1 | 11/2015 |
| WO | WO 2015/168547 A2 | 11/2015 |
| WO | WO 2015/168800 A1 | 11/2015 |
| WO | WO 2015/171603 A1 | 11/2015 |
| WO | WO 2015/171894 A1 | 11/2015 |
| WO | WO 2015/171932 A1 | 11/2015 |
| WO | WO 2015/172128 A1 | 11/2015 |
| WO | WO 2015/173436 A1 | 11/2015 |
| WO | WO 2015/175642 A2 | 11/2015 |
| WO | WO 2015/179540 A1 | 11/2015 |
| WO | WO 2015/183025 A1 | 12/2015 |
| WO | WO 2015/183026 A1 | 12/2015 |
| WO | WO 2015/183885 A1 | 12/2015 |
| WO | WO 2015/184259 A1 | 12/2015 |
| WO | WO 2015/184262 A1 | 12/2015 |
| WO | WO 2015/184268 A1 | 12/2015 |
| WO | WO 2015/188056 A1 | 12/2015 |
| WO | WO 2015/188065 A1 | 12/2015 |
| WO | WO 2015/188094 A1 | 12/2015 |
| WO | WO 2015/188109 A1 | 12/2015 |
| WO | WO 2015/188132 A1 | 12/2015 |
| WO | WO 2015/188135 A1 | 12/2015 |
| WO | WO 2015/188191 A1 | 12/2015 |
| WO | WO 2015/189693 A1 | 12/2015 |
| WO | WO 2015/191693 A2 | 12/2015 |
| WO | WO 2015/191899 A1 | 12/2015 |
| WO | WO 2015/191911 A2 | 12/2015 |
| WO | WO 2015/193858 A1 | 12/2015 |

(56) References Cited

FOREIGN PATENT DOCUMENTS

| | | |
|---|---|---|
| WO | WO 2015/195547 A1 | 12/2015 |
| WO | WO 2015/195621 A1 | 12/2015 |
| WO | WO 2015/195798 A1 | 12/2015 |
| WO | WO 2015/198020 A1 | 12/2015 |
| WO | WO 2015/200334 A1 | 12/2015 |
| WO | WO 2015/200378 A1 | 12/2015 |
| WO | WO 2015/200555 A2 | 12/2015 |
| WO | WO 2015/200805 A2 | 12/2015 |
| WO | WO 2016/001978 A1 | 1/2016 |
| WO | WO 2016/004010 A1 | 1/2016 |
| WO | WO 2016/004318 A1 | 1/2016 |
| WO | WO 2016/007347 A1 | 1/2016 |
| WO | WO 2016/007604 A1 | 1/2016 |
| WO | WO 2016/007948 A1 | 1/2016 |
| WO | WO 2016/011080 A2 | 1/2016 |
| WO | WO 2016/011210 A2 | 1/2016 |
| WO | WO 2016/011428 A1 | 1/2016 |
| WO | WO 2016/012544 A2 | 1/2016 |
| WO | WO 2016/012552 A1 | 1/2016 |
| WO | WO 2016/014409 A1 | 1/2016 |
| WO | WO 2016/014565 A2 | 1/2016 |
| WO | WO 2016/014794 A1 | 1/2016 |
| WO | WO 2016/014837 A1 | 1/2016 |
| WO | WO 2016/016119 A1 | 2/2016 |
| WO | WO 2016/016358 A1 | 2/2016 |
| WO | WO 2016/019144 A2 | 2/2016 |
| WO | WO 2016/020399 A1 | 2/2016 |
| WO | WO 2016/021972 A1 | 2/2016 |
| WO | WO 2016/021973 A1 | 2/2016 |
| WO | WO 2016/022363 A2 | 2/2016 |
| WO | WO 2016/022866 A1 | 2/2016 |
| WO | WO 2016/022931 A1 | 2/2016 |
| WO | WO 2016/025131 A1 | 2/2016 |
| WO | WO 2016/025469 A1 | 2/2016 |
| WO | WO 2016/025759 A1 | 2/2016 |
| WO | WO 2016/026444 A1 | 2/2016 |
| WO | WO 2016/028682 A1 | 2/2016 |
| WO | WO 2016/028843 A2 | 2/2016 |
| WO | WO 2016/028887 A1 | 2/2016 |
| WO | WO 2016/033088 A1 | 3/2016 |
| WO | WO 2016/033230 A1 | 3/2016 |
| WO | WO 2016/033246 A1 | 3/2016 |
| WO | WO 2016/033298 A1 | 3/2016 |
| WO | WO 2016/035044 A1 | 3/2016 |
| WO | WO 2016/036754 A1 | 3/2016 |
| WO | WO 2016/037157 A2 | 3/2016 |
| WO | WO 2016/040030 A1 | 3/2016 |
| WO | WO 2016/040594 A1 | 3/2016 |
| WO | WO 2016/044182 A1 | 3/2016 |
| WO | WO 2016/044416 A1 | 3/2016 |
| WO | WO 2016/046635 A1 | 3/2016 |
| WO | WO 2016/049024 A2 | 3/2016 |
| WO | WO 2016/049163 A2 | 3/2016 |
| WO | WO 2016/049230 A1 | 3/2016 |
| WO | WO 2016/049251 A1 | 3/2016 |
| WO | WO 2016/049258 A2 | 3/2016 |
| WO | WO 2016/053397 A2 | 4/2016 |
| WO | WO 2016/054326 A1 | 4/2016 |
| WO | WO 2016/057061 A2 | 4/2016 |
| WO | WO 2016/057821 A2 | 4/2016 |
| WO | WO 2016/057835 A2 | 4/2016 |
| WO | WO 2016/057850 A1 | 4/2016 |
| WO | WO 2016/057951 A2 | 4/2016 |
| WO | WO 2016/057961 A1 | 4/2016 |
| WO | WO 2016/061073 A1 | 4/2016 |
| WO | WO 2016/061374 A1 | 4/2016 |
| WO | WO 2016/061481 A1 | 4/2016 |
| WO | WO 2016/061523 A1 | 4/2016 |
| WO | WO 2016/064894 A2 | 4/2016 |
| WO | WO 2016/065364 A1 | 4/2016 |
| WO | WO 2016/069282 A1 | 5/2016 |
| WO | WO 2016/069283 A1 | 5/2016 |
| WO | WO 2016/069591 A2 | 5/2016 |
| WO | WO 2016/069774 A1 | 5/2016 |
| WO | WO 2016/069910 A1 | 5/2016 |
| WO | WO 2016/069912 A1 | 5/2016 |
| WO | WO 2016/070037 A2 | 5/2016 |
| WO | WO 2016/070070 A1 | 5/2016 |
| WO | WO 2016/070129 A1 | 5/2016 |
| WO | WO 2016/072399 A1 | 5/2016 |
| WO | WO 2016/072936 A1 | 5/2016 |
| WO | WO 2016/073433 A1 | 5/2016 |
| WO | WO 2016/073559 A1 | 5/2016 |
| WO | WO 2016/073990 A2 | 5/2016 |
| WO | WO 2016/075662 A2 | 5/2016 |
| WO | WO 2016/076672 A1 | 5/2016 |
| WO | WO 2016/077273 A1 | 5/2016 |
| WO | WO 2016/077350 A1 | 5/2016 |
| WO | WO 2016/080097 A1 | 5/2016 |
| WO | WO 2016/080795 A1 | 5/2016 |
| WO | WO 2016/081923 A2 | 5/2016 |
| WO | WO 2016/081924 A1 | 5/2016 |
| WO | WO 2016/082135 A1 | 6/2016 |
| WO | WO 2016/083811 A1 | 6/2016 |
| WO | WO 2016/084084 A1 | 6/2016 |
| WO | WO 2016/084088 A1 | 6/2016 |
| WO | WO 2016/086177 A2 | 6/2016 |
| WO | WO 2016/089433 A1 | 6/2016 |
| WO | WO 2016/089866 A1 | 6/2016 |
| WO | WO 2016/089883 A1 | 6/2016 |
| WO | WO 2016/090385 A1 | 6/2016 |
| WO | WO 2016/094679 A1 | 6/2016 |
| WO | WO 2016/094845 A2 | 6/2016 |
| WO | WO 2016/094867 A1 | 6/2016 |
| WO | WO 2016/094872 A1 | 6/2016 |
| WO | WO 2016/094874 A1 | 6/2016 |
| WO | WO 2016/094880 A1 | 6/2016 |
| WO | WO 2016/094888 A1 | 6/2016 |
| WO | WO 2016/097212 A1 | 6/2016 |
| WO | WO 2016/097231 A2 | 6/2016 |
| WO | WO 2016/097751 A1 | 6/2016 |
| WO | WO 2016/099887 A1 | 6/2016 |
| WO | WO 2016/100272 A1 | 6/2016 |
| WO | WO 2016/100389 A1 | 6/2016 |
| WO | WO 2016/100568 A1 | 6/2016 |
| WO | WO 2016/100571 A1 | 6/2016 |
| WO | WO 2016/100951 A2 | 6/2016 |
| WO | WO 2016/100955 A2 | 6/2016 |
| WO | WO 2016/100974 A1 | 6/2016 |
| WO | WO 2016/103233 A2 | 6/2016 |
| WO | WO 2016/104716 A1 | 6/2016 |
| WO | WO 2016/106236 A1 | 6/2016 |
| WO | WO 2016/106239 A1 | 6/2016 |
| WO | WO 2016/106244 A1 | 6/2016 |
| WO | WO 2016/106338 A2 | 6/2016 |
| WO | WO 2016/108926 A1 | 7/2016 |
| WO | WO 2016/109255 A1 | 7/2016 |
| WO | WO 2016/109840 A2 | 7/2016 |
| WO | WO 2016/110214 A1 | 7/2016 |
| WO | WO 2016/110453 A1 | 7/2016 |
| WO | WO 2016/110511 A1 | 7/2016 |
| WO | WO 2016/110512 A1 | 7/2016 |
| WO | WO 2016/111546 A2 | 7/2016 |
| WO | WO 2016/112242 A1 | 7/2016 |
| WO | WO 2016/112351 A1 | 7/2016 |
| WO | WO 2016/112963 A1 | 7/2016 |
| WO | WO 2016/113357 A1 | 7/2016 |
| WO | WO 2016/114972 A1 | 7/2016 |
| WO | WO 2016/115179 A1 | 7/2016 |
| WO | WO 2016/115326 A1 | 7/2016 |
| WO | WO 2016/115355 A1 | 7/2016 |
| WO | WO 2016/116032 A1 | 7/2016 |
| WO | WO 2016/120480 A1 | 8/2016 |
| WO | WO 2016/123071 A1 | 8/2016 |
| WO | WO 2016/123230 A1 | 8/2016 |
| WO | WO 2016/123243 A1 | 8/2016 |
| WO | WO 2016/123578 A1 | 8/2016 |
| WO | WO 2016/126747 A1 | 8/2016 |
| WO | WO 2016/130600 A2 | 8/2016 |
| WO | WO 2016/130697 A1 | 8/2016 |
| WO | WO 2016/131009 A1 | 8/2016 |
| WO | WO 2016/132122 A1 | 8/2016 |
| WO | WO 2016/133165 A1 | 8/2016 |
| WO | WO 2016/135507 A1 | 9/2016 |

(56) References Cited

FOREIGN PATENT DOCUMENTS

| | | |
|---|---|---|
| WO | WO 2016/135557 A2 | 9/2016 |
| WO | WO 2016/135558 A2 | 9/2016 |
| WO | WO 2016/135559 A2 | 9/2016 |
| WO | WO 2016/137774 A1 | 9/2016 |
| WO | WO 2016/137949 A1 | 9/2016 |
| WO | WO 2016/141224 A1 | 9/2016 |
| WO | WO 2016/141893 A1 | 9/2016 |
| WO | WO 2016/142719 A1 | 9/2016 |
| WO | WO 2016/145150 A2 | 9/2016 |
| WO | WO 2016/148994 A1 | 9/2016 |
| WO | WO 2016/149484 A2 | 9/2016 |
| WO | WO 2016/149547 A1 | 9/2016 |
| WO | WO 2016/150336 A1 | 9/2016 |
| WO | WO 2016/150855 A1 | 9/2016 |
| WO | WO 2016/154016 A2 | 9/2016 |
| WO | WO 2016/154579 A2 | 9/2016 |
| WO | WO 2016/154596 A1 | 9/2016 |
| WO | WO 2016/155482 A1 | 10/2016 |
| WO | WO 2016/161004 A1 | 10/2016 |
| WO | WO 2016/161207 A1 | 10/2016 |
| WO | WO 2016/161260 A1 | 10/2016 |
| WO | WO 2016/161380 A1 | 10/2016 |
| WO | WO 2016/161446 A1 | 10/2016 |
| WO | WO 2016/164356 A1 | 10/2016 |
| WO | WO 2016/164797 A1 | 10/2016 |
| WO | WO 2016/166340 A1 | 10/2016 |
| WO | WO 2016/167300 A1 | 10/2016 |
| WO | WO 2016/168631 A1 | 10/2016 |
| WO | WO 2016/170484 A1 | 10/2016 |
| WO | WO 2016/172359 A1 | 10/2016 |
| WO | WO 2016/172727 A1 | 10/2016 |
| WO | WO 2016/174056 A1 | 11/2016 |
| WO | WO 2016/174151 A1 | 11/2016 |
| WO | WO 2016/174250 A1 | 11/2016 |
| WO | WO 2016/176191 A1 | 11/2016 |
| WO | WO 2016/176404 A1 | 11/2016 |
| WO | WO 2016/176690 A2 | 11/2016 |
| WO | WO 2016/177682 A1 | 11/2016 |
| WO | WO 2016/178207 A1 | 11/2016 |
| WO | WO 2016/179038 A1 | 11/2016 |
| WO | WO 2016/179112 A1 | 11/2016 |
| WO | WO 2016/181357 A1 | 11/2016 |
| WO | WO 2016/182893 A1 | 11/2016 |
| WO | WO 2016/182917 A1 | 11/2016 |
| WO | WO 2016/182959 A1 | 11/2016 |
| WO | WO 2016/183236 A1 | 11/2016 |
| WO | WO 2016/183298 A2 | 11/2016 |
| WO | WO 2016/183345 A1 | 11/2016 |
| WO | WO 2016/183402 A2 | 11/2016 |
| WO | WO 2016/183438 A1 | 11/2016 |
| WO | WO 2016/183448 A1 | 11/2016 |
| WO | WO 2016/184955 A2 | 11/2016 |
| WO | WO 2016/184989 A1 | 11/2016 |
| WO | WO 2016/185411 A1 | 11/2016 |
| WO | WO 2016/186745 A1 | 11/2016 |
| WO | WO 2016/186772 A2 | 11/2016 |
| WO | WO 2016/186946 A1 | 11/2016 |
| WO | WO 2016/186953 A1 | 11/2016 |
| WO | WO 2016/187717 A1 | 12/2016 |
| WO | WO 2016/187904 A1 | 12/2016 |
| WO | WO 2016/191684 A1 | 12/2016 |
| WO | WO 2016/191869 A1 | 12/2016 |
| WO | WO 2016/196273 A1 | 12/2016 |
| WO | WO 2016/196282 A1 | 12/2016 |
| WO | WO 2016/196308 A1 | 12/2016 |
| WO | WO 2016/196361 A1 | 12/2016 |
| WO | WO 2016/196499 A1 | 12/2016 |
| WO | WO 2016/196539 A2 | 12/2016 |
| WO | WO 2016/196655 A1 | 12/2016 |
| WO | WO 2016/196805 A1 | 12/2016 |
| WO | WO 2016/196887 A1 | 12/2016 |
| WO | WO 2016/197132 A1 | 12/2016 |
| WO | WO 2016/197133 A1 | 12/2016 |
| WO | WO 2016/197354 A1 | 12/2016 |
| WO | WO 2016/197355 A1 | 12/2016 |
| WO | WO 2016/197356 A1 | 12/2016 |
| WO | WO 2016/197357 A1 | 12/2016 |
| WO | WO 2016/197358 A1 | 12/2016 |
| WO | WO 2016/197359 A1 | 12/2016 |
| WO | WO 2016/197360 A1 | 12/2016 |
| WO | WO 2016/197361 A1 | 12/2016 |
| WO | WO 2016/197362 A1 | 12/2016 |
| WO | WO 2016/198361 A1 | 12/2016 |
| WO | WO 2016/198500 A1 | 12/2016 |
| WO | WO 2016/200263 A1 | 12/2016 |
| WO | WO 2016/201047 A1 | 12/2016 |
| WO | WO 2016/201138 A1 | 12/2016 |
| WO | WO 2016/201152 A1 | 12/2016 |
| WO | WO 2016/201153 A1 | 12/2016 |
| WO | WO 2016/201155 A1 | 12/2016 |
| WO | WO 2016/205276 A1 | 12/2016 |
| WO | WO 2016/205613 A1 | 12/2016 |
| WO | WO 2016/205623 A1 | 12/2016 |
| WO | WO 2016/205680 A1 | 12/2016 |
| WO | WO 2016/205688 A2 | 12/2016 |
| WO | WO 2016/205703 A1 | 12/2016 |
| WO | WO 2016/205711 A1 | 12/2016 |
| WO | WO 2016/205728 A1 | 12/2016 |
| WO | WO 2016/205745 A2 | 12/2016 |
| WO | WO 2016/205749 A1 | 12/2016 |
| WO | WO 2016/205759 A1 | 12/2016 |
| WO | WO 2016/205764 A1 | 12/2016 |
| WO | WO 2017/001572 A1 | 1/2017 |
| WO | WO 2017/001988 A1 | 1/2017 |
| WO | WO 2017/004261 A1 | 1/2017 |
| WO | WO 2017/004279 A2 | 1/2017 |
| WO | WO 2017/004616 A1 | 1/2017 |
| WO | WO 2017/005807 A1 | 1/2017 |
| WO | WO 2017/009399 A1 | 1/2017 |
| WO | WO 2017/010556 A1 | 1/2017 |
| WO | WO 2017/011519 A1 | 1/2017 |
| WO | WO 2017/011721 A1 | 1/2017 |
| WO | WO 2017/011804 A1 | 1/2017 |
| WO | WO 2017/015015 A1 | 1/2017 |
| WO | WO 2017/015101 A1 | 1/2017 |
| WO | WO 2017/015545 A1 | 1/2017 |
| WO | WO 2017/015567 A1 | 1/2017 |
| WO | WO 2017/015637 A1 | 1/2017 |
| WO | WO 2017/017016 A1 | 2/2017 |
| WO | WO 2017/019867 A1 | 2/2017 |
| WO | WO 2017/019895 A1 | 2/2017 |
| WO | WO 2017/023803 A1 | 2/2017 |
| WO | WO 2017/023974 A1 | 2/2017 |
| WO | WO 2017/024047 A1 | 2/2017 |
| WO | WO 2017/024319 A1 | 2/2017 |
| WO | WO 2017/024343 A1 | 2/2017 |
| WO | WO 2017/024602 A1 | 2/2017 |
| WO | WO 2017/025323 A1 | 2/2017 |
| WO | WO 2017/027423 A1 | 2/2017 |
| WO | WO 2017/028768 A1 | 2/2017 |
| WO | WO 2017/029664 A1 | 2/2017 |
| WO | WO 2017/031360 A1 | 2/2017 |
| WO | WO 2017/031483 A1 | 2/2017 |
| WO | WO 2017/035416 A2 | 3/2017 |
| WO | WO 2017/040348 A1 | 3/2017 |
| WO | WO 2017/040511 A1 | 3/2017 |
| WO | WO 2017/040709 A1 | 3/2017 |
| WO | WO 2017/040786 A1 | 3/2017 |
| WO | WO 2017/040793 A1 | 3/2017 |
| WO | WO 2017/040813 A2 | 3/2017 |
| WO | WO 2017/043573 A1 | 3/2017 |
| WO | WO 2017/043656 A1 | 3/2017 |
| WO | WO 2017/044419 A1 | 3/2017 |
| WO | WO 2017/044776 A1 | 3/2017 |
| WO | WO 2017/044857 A2 | 3/2017 |
| WO | WO 2017/048390 A1 | 3/2017 |
| WO | WO 2017/049129 A2 | 3/2017 |
| WO | WO 2017/050963 A1 | 3/2017 |
| WO | WO 2017/053312 A1 | 3/2017 |
| WO | WO 2017/053431 A2 | 3/2017 |
| WO | WO 2017/053713 A1 | 3/2017 |
| WO | WO 2017/053729 A1 | 3/2017 |
| WO | WO 2017/053753 A1 | 3/2017 |
| WO | WO 2017/053762 A1 | 3/2017 |

(56) References Cited

FOREIGN PATENT DOCUMENTS

| | | |
|---|---|---|
| WO | WO 2017/053879 A1 | 3/2017 |
| WO | WO 2017/054721 A1 | 4/2017 |
| WO | WO 2017/058658 A2 | 4/2017 |
| WO | WO 2017/059241 A1 | 4/2017 |
| WO | WO 2017/062605 A1 | 4/2017 |
| WO | WO 2017/062723 A1 | 4/2017 |
| WO | WO 2017/062754 A1 | 4/2017 |
| WO | WO 2017/062855 A1 | 4/2017 |
| WO | WO 2017/062886 A1 | 4/2017 |
| WO | WO 2017/062983 A1 | 4/2017 |
| WO | WO 2017/064439 A1 | 4/2017 |
| WO | WO 2017/064546 A1 | 4/2017 |
| WO | WO 2017/064566 A2 | 4/2017 |
| WO | WO 2017/066175 A1 | 4/2017 |
| WO | WO 2017/066497 A2 | 4/2017 |
| WO | WO 2017/066588 A2 | 4/2017 |
| WO | WO 2017/066707 A1 | 4/2017 |
| WO | WO 2017/066781 A1 | 4/2017 |
| WO | WO 2017/068077 A1 | 4/2017 |
| WO | WO 2017/068377 A1 | 4/2017 |
| WO | WO 2017/069829 A2 | 4/2017 |
| WO | WO 2017/070029 A1 | 4/2017 |
| WO | WO 2017/070032 A1 | 4/2017 |
| WO | WO 2017/070169 A1 | 4/2017 |
| WO | WO 2017/070284 A1 | 4/2017 |
| WO | WO 2017/070598 A1 | 4/2017 |
| WO | WO 2017/070605 A1 | 4/2017 |
| WO | WO 2017/070632 A2 | 4/2017 |
| WO | WO 2017/070633 A2 | 4/2017 |
| WO | WO 2017/072590 A1 | 5/2017 |
| WO | WO 2017/074526 A1 | 5/2017 |
| WO | WO 2017/074962 A1 | 5/2017 |
| WO | WO 2017/075261 A1 | 5/2017 |
| WO | WO 2017/075335 A1 | 5/2017 |
| WO | WO 2017/075475 A1 | 5/2017 |
| WO | WO 2017/077135 A1 | 5/2017 |
| WO | WO 2017/077329 A2 | 5/2017 |
| WO | WO 2017/078751 A1 | 5/2017 |
| WO | WO 2017/079400 A1 | 5/2017 |
| WO | WO 2017/079428 A1 | 5/2017 |
| WO | WO 2017/079673 A1 | 5/2017 |
| WO | WO 2017/079724 A1 | 5/2017 |
| WO | WO 2017/081097 A1 | 5/2017 |
| WO | WO 2017/081288 A1 | 5/2017 |
| WO | WO 2017/083368 A1 | 5/2017 |
| WO | WO 2017/083722 A1 | 5/2017 |
| WO | WO 2017/083766 A1 | 5/2017 |
| WO | WO 2017/087395 A1 | 5/2017 |
| WO | WO 2017/090724 A1 | 6/2017 |
| WO | WO 2017/091510 A1 | 6/2017 |
| WO | WO 2017/091630 A1 | 6/2017 |
| WO | WO 2017/092201 A1 | 6/2017 |
| WO | WO 2017/093370 A1 | 6/2017 |
| WO | WO 2017/093969 A1 | 6/2017 |
| WO | WO 2017/095111 A1 | 6/2017 |
| WO | WO 2017/096041 A1 | 6/2017 |
| WO | WO 2017/096237 A1 | 6/2017 |
| WO | WO 2017/100158 A1 | 6/2017 |
| WO | WO 2017/100431 A2 | 6/2017 |
| WO | WO 2017/104404 A1 | 6/2017 |
| WO | WO 2017/105251 A1 | 6/2017 |
| WO | WO 2017/105350 A1 | 6/2017 |
| WO | WO 2017/105991 A1 | 6/2017 |
| WO | WO 2017/106414 A1 | 6/2017 |
| WO | WO 2017/106528 A2 | 6/2017 |
| WO | WO 2017/106537 A2 | 6/2017 |
| WO | WO 2017/106569 A1 | 6/2017 |
| WO | WO 2017/106616 A1 | 6/2017 |
| WO | WO 2017/106657 A1 | 6/2017 |
| WO | WO 2017/106767 A1 | 6/2017 |
| WO | WO 2017/109134 A1 | 6/2017 |
| WO | WO 2017/109757 A1 | 6/2017 |
| WO | WO 2017/112620 A1 | 6/2017 |
| WO | WO 2017/115268 A1 | 7/2017 |
| WO | WO 2017/117395 A1 | 7/2017 |
| WO | WO 2017/118598 A1 | 7/2017 |
| WO | WO 2017/118720 A1 | 7/2017 |
| WO | WO 2017/123609 A1 | 7/2017 |
| WO | WO 2017/123910 A1 | 7/2017 |
| WO | WO 2017/124086 A1 | 7/2017 |
| WO | WO 2017/124100 A1 | 7/2017 |
| WO | WO 2017/124652 A1 | 7/2017 |
| WO | WO 2017/126987 A1 | 7/2017 |
| WO | WO 2017/127807 A1 | 7/2017 |
| WO | WO 2017/131237 A1 | 8/2017 |
| WO | WO 2017/132112 A1 | 8/2017 |
| WO | WO 2017/132580 A2 | 8/2017 |
| WO | WO 2017/136520 A1 | 8/2017 |
| WO | WO 2017/136629 A1 | 8/2017 |
| WO | WO 2017/136794 A1 | 8/2017 |
| WO | WO 2017/139264 A1 | 8/2017 |
| WO | WO 2017/139505 A2 | 8/2017 |
| WO | WO 2017/141173 A2 | 8/2017 |
| WO | WO 2017/142835 A1 | 8/2017 |
| WO | WO 2017/142999 A2 | 8/2017 |
| WO | WO 2017/143042 A2 | 8/2017 |
| WO | WO 2017/147056 A1 | 8/2017 |
| WO | WO 2017/147278 A1 | 8/2017 |
| WO | WO 2017/147432 A1 | 8/2017 |
| WO | WO 2017/147446 A1 | 8/2017 |
| WO | WO 2017/147555 A1 | 8/2017 |
| WO | WO 2017/151444 A1 | 9/2017 |
| WO | WO 2017/151719 A1 | 9/2017 |
| WO | WO 2017/152015 A1 | 9/2017 |
| WO | WO 2017/155717 A1 | 9/2017 |
| WO | WO 2017/157422 A1 | 9/2017 |
| WO | WO 2017/158153 A1 | 9/2017 |
| WO | WO 2017/160689 A1 | 9/2017 |
| WO | WO 2017/160752 A1 | 9/2017 |
| WO | WO 2017/160890 A1 | 9/2017 |
| WO | WO 2017/161068 A1 | 9/2017 |
| WO | WO 2017/165826 A1 | 9/2017 |
| WO | WO 2017/165862 A1 | 9/2017 |
| WO | WO 2017/167712 A1 | 10/2017 |
| WO | WO 2017/172644 A2 | 10/2017 |
| WO | WO 2017/172645 A2 | 10/2017 |
| WO | WO 2017/172860 A1 | 10/2017 |
| WO | WO 2017/173004 A1 | 10/2017 |
| WO | WO 2017/173054 A1 | 10/2017 |
| WO | WO 2017/173092 A1 | 10/2017 |
| WO | WO 2017/174329 A1 | 10/2017 |
| WO | WO 2017/176529 A1 | 10/2017 |
| WO | WO 2017/176806 A1 | 10/2017 |
| WO | WO 2017/178590 A1 | 10/2017 |
| WO | WO 2017/180694 A1 | 10/2017 |
| WO | WO 2017/180711 A1 | 10/2017 |
| WO | WO 2017/180915 A2 | 10/2017 |
| WO | WO 2017/180926 A1 | 10/2017 |
| WO | WO 2017/181107 A2 | 10/2017 |
| WO | WO 2017/181735 A2 | 10/2017 |
| WO | WO 2017/182468 A1 | 10/2017 |
| WO | WO 2017/184334 A1 | 10/2017 |
| WO | WO 2017/184768 A1 | 10/2017 |
| WO | WO 2017/184786 A1 | 10/2017 |
| WO | WO 2017/186550 A1 | 11/2017 |
| WO | WO 2017/189308 A1 | 11/2017 |
| WO | WO 2017/189336 A1 | 11/2017 |
| WO | WO 2017/190041 A1 | 11/2017 |
| WO | WO 2017/190257 A1 | 11/2017 |
| WO | WO 2017/190664 A1 | 11/2017 |
| WO | WO 2017/191210 A1 | 11/2017 |
| WO | WO 2017/191274 A2 | 11/2017 |
| WO | WO 2017/192172 A1 | 11/2017 |
| WO | WO 2017/192512 A2 | 11/2017 |
| WO | WO 2017/192544 A1 | 11/2017 |
| WO | WO 2017/192573 A1 | 11/2017 |
| WO | WO 2017/193029 A2 | 11/2017 |
| WO | WO 2017/193053 A1 | 11/2017 |
| WO | WO 2017/196768 A1 | 11/2017 |
| WO | WO 2017/197038 A1 | 11/2017 |
| WO | WO 2017/197238 A1 | 11/2017 |
| WO | WO 2017/197301 A1 | 11/2017 |
| WO | WO 2017/201476 A1 | 11/2017 |
| WO | WO 2017/205290 A1 | 11/2017 |

(56) References Cited

FOREIGN PATENT DOCUMENTS

| | | |
|---|---|---|
| WO | WO 2017/205423 A1 | 11/2017 |
| WO | WO 2017/207589 A1 | 12/2017 |
| WO | WO 2017/208247 A1 | 12/2017 |
| WO | WO 2017/209809 A1 | 12/2017 |
| WO | WO 2017/213896 A1 | 12/2017 |
| WO | WO 2017/213898 A1 | 12/2017 |
| WO | WO 2017/214460 A1 | 12/2017 |
| WO | WO 2017/216392 A1 | 12/2017 |
| WO | WO 2017/216771 A2 | 12/2017 |
| WO | WO 2017/218185 A1 | 12/2017 |
| WO | WO 2017/219027 A1 | 12/2017 |
| WO | WO 2017/219033 A1 | 12/2017 |
| WO | WO 2017/220751 A1 | 12/2017 |
| WO | WO 2017/222370 A1 | 12/2017 |
| WO | WO 2017/222773 A1 | 12/2017 |
| WO | WO 2017/222834 A1 | 12/2017 |
| WO | WO 2017/223107 A1 | 12/2017 |
| WO | WO 2017/223330 A1 | 12/2017 |
| WO | WO 2018/000657 A1 | 1/2018 |
| WO | WO 2018/002719 A1 | 1/2018 |
| WO | WO 2018/005117 A1 | 1/2018 |
| WO | WO 2018/005289 A2 | 1/2018 |
| WO | WO 2018/005691 A1 | 1/2018 |
| WO | WO 2018/005782 A1 | 1/2018 |
| WO | WO 2018/005873 A1 | 1/2018 |
| WO | WO 2018/06693 A1 | 1/2018 |
| WO | WO 2018/009520 A1 | 1/2018 |
| WO | WO 2018/009562 A1 | 1/2018 |
| WO | WO 2018/009822 A1 | 1/2018 |
| WO | WO 2018/013821 A1 | 1/2018 |
| WO | WO 2018/013932 A1 | 1/2018 |
| WO | WO 2018/013990 A1 | 1/2018 |
| WO | WO 2018/014384 A1 | 1/2018 |
| WO | WO 2018/015444 A1 | 1/2018 |
| WO | WO 2018/015936 A2 | 1/2018 |
| WO | WO 2018/017754 A1 | 1/2018 |
| WO | WO 2018/018979 A1 | 2/2018 |
| WO | WO 2018/020248 A1 | 2/2018 |
| WO | WO 2018/021878 A1 | 2/2018 |
| WO | WO 2018/022480 A1 | 2/2018 |
| WO | WO 2018/022634 A1 | 2/2018 |
| WO | WO 2018/025206 A1 | 2/2018 |
| WO | WO 2018/026723 A1 | 2/2018 |
| WO | WO 2018/026976 A1 | 2/2018 |
| WO | WO 2018/027078 A1 | 2/2018 |
| WO | WO 2018/030608 A1 | 2/2018 |
| WO | WO 2018/031683 A1 | 2/2018 |
| WO | WO 2018/035250 A1 | 2/2018 |
| WO | WO 2018/035300 A1 | 2/2018 |
| WO | WO 2018/035423 A1 | 2/2018 |
| WO | WO 2018/035503 A1 | 2/2018 |
| WO | WO 2018/039145 A1 | 3/2018 |
| WO | WO 2018/039438 A1 | 3/2018 |
| WO | WO 2018/039440 A1 | 3/2018 |
| WO | WO 2018/039448 A1 | 3/2018 |
| WO | WO 2018/045630 A1 | 3/2018 |
| WO | WO 2018/048827 A1 | 3/2018 |
| WO | WO 2018/049073 A1 | 3/2018 |
| WO | WO 2018/049168 A1 | 3/2018 |
| WO | WO 2018/051347 A1 | 3/2018 |
| WO | WO 2018/058064 A1 | 3/2018 |
| WO | WO 2018/062866 A2 | 4/2018 |
| WO | WO 2018/064352 A1 | 4/2018 |
| WO | WO 2018/064371 A1 | 4/2018 |
| WO | WO 2018/064516 A1 | 4/2018 |
| WO | WO 2018/067546 A1 | 4/2018 |
| WO | WO 2018/067846 A1 | 4/2018 |
| WO | WO 2018/068053 A2 | 4/2018 |
| WO | WO 2018/069474 A1 | 4/2018 |
| WO | WO 2018/071623 A2 | 4/2018 |
| WO | WO 2018/071663 A1 | 4/2018 |
| WO | WO 2018/071868 A1 | 4/2018 |
| WO | WO 2018/071892 A1 | 4/2018 |
| WO | WO 2018/074979 A1 | 4/2018 |
| WO | WO 2018/079134 A1 | 5/2018 |
| WO | WO 2018/080573 A1 | 5/2018 |
| WO | WO 2018/081504 A1 | 5/2018 |
| WO | WO 2018/081535 A2 | 5/2018 |
| WO | WO 2018/081728 A1 | 5/2018 |
| WO | WO 2018/083128 A2 | 5/2018 |
| WO | WO 2018/083606 A1 | 5/2018 |
| WO | WO 2018/085288 A1 | 5/2018 |
| WO | WO 2018/085414 A1 | 5/2018 |
| WO | WO 2018/086623 A1 | 5/2018 |
| WO | WO 2018/089664 A1 | 5/2018 |
| WO | WO 2018/093990 A1 | 5/2018 |
| WO | WO 2018/098383 A1 | 5/2018 |
| WO | WO 2018/098480 A1 | 5/2018 |
| WO | WO 2018/098587 A1 | 6/2018 |
| WO | WO 2018/099256 A1 | 6/2018 |
| WO | WO 2018/103686 A1 | 6/2018 |
| WO | WO 2018/106268 A1 | 6/2018 |
| WO | WO 2018/107028 A1 | 6/2018 |
| WO | WO 2018/107103 A1 | 6/2018 |
| WO | WO 2018/107129 A1 | 6/2018 |
| WO | WO 2018/108272 A1 | 6/2018 |
| WO | WO 2018/109101 A1 | 6/2018 |
| WO | WO 2018/111946 A1 | 6/2018 |
| WO | WO 2018/111947 A1 | 6/2018 |
| WO | WO 2018/112336 A1 | 6/2018 |
| WO | WO 2018/112446 A2 | 6/2018 |
| WO | WO 2018/119354 A1 | 6/2018 |
| WO | WO 2018/119359 A1 | 6/2018 |
| WO | WO 2018/120283 A1 | 7/2018 |
| WO | WO 2018/130830 A1 | 7/2018 |
| WO | WO 2018/135838 A1 | 7/2018 |
| WO | WO 2018/136396 A2 | 7/2018 |
| WO | WO 2018/138385 A1 | 8/2018 |
| WO | WO 2018/142364 A1 | 8/2018 |
| WO | WO 2018/148246 A1 | 8/2018 |
| WO | WO 2018/148256 A1 | 8/2018 |
| WO | WO 2018/148647 A2 | 8/2018 |
| WO | WO 2018/149418 A1 | 8/2018 |
| WO | WO 2018/149888 A1 | 8/2018 |
| WO | WO 2018/149915 A1 | 8/2018 |
| WO | WO 2018/152197 A1 | 8/2018 |
| WO | WO 2018/152418 A1 | 8/2018 |
| WO | WO 2018/154380 A1 | 8/2018 |
| WO | WO 2018/154387 A1 | 8/2018 |
| WO | WO 2018/154412 A1 | 8/2018 |
| WO | WO 2018/154413 A1 | 8/2018 |
| WO | WO 2018/154418 A1 | 8/2018 |
| WO | WO 2018/154439 A1 | 8/2018 |
| WO | WO 2018/154459 A1 | 8/2018 |
| WO | WO 2018/154462 A2 | 8/2018 |
| WO | WO 2018/156372 A1 | 8/2018 |
| WO | WO 2018/156824 A1 | 8/2018 |
| WO | WO 2018/161009 A1 | 9/2018 |
| WO | WO 2018/165504 A1 | 9/2018 |
| WO | WO 2018/165629 A1 | 9/2018 |
| WO | WO 2018/170015 A1 | 9/2018 |
| WO | WO 2018/170340 A1 | 9/2018 |
| WO | WO 2018/175502 A2 | 9/2018 |
| WO | WO 2018/176009 A1 | 9/2018 |
| WO | WO 2018/177351 A1 | 10/2018 |
| WO | WO 2018/179578 A1 | 10/2018 |
| WO | WO 2018/183403 A1 | 10/2018 |
| WO | WO 2018/189184 A1 | 10/2018 |
| WO | WO 2018/191388 A1 | 10/2018 |
| WO | WO 2018/195402 A1 | 10/2018 |
| WO | WO 2018/195545 A2 | 10/2018 |
| WO | WO 2018/195555 A1 | 10/2018 |
| WO | WO 2018/197020 A1 | 11/2018 |
| WO | WO 2018/197495 A1 | 11/2018 |
| WO | WO 2018/202800 A1 | 11/2018 |
| WO | WO 2018/204493 A1 | 11/2018 |
| WO | WO 2018/208755 A1 | 11/2018 |
| WO | WO 2018/208998 A1 | 11/2018 |
| WO | WO 2018/209158 A2 | 11/2018 |
| WO | WO 2018/209320 A1 | 11/2018 |
| WO | WO 2018/213351 A1 | 11/2018 |
| WO | WO 2018/213708 A1 | 11/2018 |
| WO | WO 2018/213726 A1 | 11/2018 |
| WO | WO 2018/213771 A1 | 11/2018 |

(56) References Cited

FOREIGN PATENT DOCUMENTS

| | | |
|---|---|---|
| WO | WO 2018/213791 A1 | 11/2018 |
| WO | WO 2018/217852 A1 | 11/2018 |
| WO | WO 2018/217981 A1 | 11/2018 |
| WO | WO 2018/218166 A1 | 11/2018 |
| WO | WO 2018/218188 A2 | 11/2018 |
| WO | WO 2018/218206 A1 | 11/2018 |
| WO | WO 2018/226855 A1 | 12/2018 |
| WO | WO 2019/005884 A1 | 1/2019 |
| WO | WO 2019/005886 A1 | 1/2019 |
| WO | WO 2019/010384 A1 | 1/2019 |
| WO | WO 2019/023680 A1 | 1/2019 |
| WO | WO 2019/051097 A1 | 3/2019 |
| WO | WO 2019/079347 A1 | 4/2019 |
| WO | WO 2019/084062 A1 | 5/2019 |
| WO | WO 2019/090367 A1 | 5/2019 |
| WO | WO 2019/092042 A1 | 5/2019 |
| WO | WO 2019/118935 A1 | 6/2019 |
| WO | WO 2019/118949 A1 | 6/2019 |
| WO | WO 2019/123430 A1 | 6/2019 |
| WO | WO 2019/139645 A2 | 7/2019 |
| WO | WO 2019/139951 A1 | 7/2019 |
| WO | WO 2019/147014 A1 | 8/2019 |
| WO | WO 2019/161251 A1 | 8/2019 |
| WO | WO 2019/168953 A1 | 9/2019 |
| WO | WO 2019/183641 A1 | 9/2019 |
| WO | WO 2019/217942 A1 | 11/2019 |
| WO | WO 2019/226593 A1 | 11/2019 |
| WO | WO 2019/226953 A1 | 11/2019 |
| WO | WO 2019/236566 A1 | 12/2019 |
| WO | WO 2019/241649 A1 | 12/2019 |
| WO | WO 2020/014261 A1 | 1/2020 |
| WO | WO 2020/028555 A2 | 2/2020 |
| WO | WO 2020/028823 A1 | 2/2020 |
| WO | WO 2020/041751 A1 | 2/2020 |
| WO | WO 2020/047124 A1 | 3/2020 |
| WO | WO 2020/051360 A1 | 3/2020 |
| WO | WO 2020/086908 A1 | 4/2020 |
| WO | WO 2020/092453 A1 | 5/2020 |
| WO | WO 2020/102659 A1 | 5/2020 |
| WO | WO 2020/154500 A1 | 7/2020 |
| WO | WO 2020/157008 A1 | 8/2020 |
| WO | WO 2020/160071 A1 | 8/2020 |
| WO | WO 2020/160517 A1 | 8/2020 |
| WO | WO 2020/180975 A1 | 9/2020 |
| WO | WO 2020/181178 A1 | 9/2020 |
| WO | WO 2020/181180 A1 | 9/2020 |
| WO | WO 2020/181193 A1 | 9/2020 |
| WO | WO 2020/181195 A1 | 9/2020 |
| WO | WO 2020/181202 A1 | 9/2020 |
| WO | WO 2020/191153 A1 | 9/2020 |
| WO | WO 2020/191171 A1 | 9/2020 |
| WO | WO 2020/191233 A1 | 9/2020 |
| WO | WO 2020/191234 A1 | 9/2020 |
| WO | WO 2020/191239 A1 | 9/2020 |
| WO | WO 2020/191241 A1 | 9/2020 |
| WO | WO 2020/191242 A1 | 9/2020 |
| WO | WO 2020/191243 A1 | 9/2020 |
| WO | WO 2020/191245 A1 | 9/2020 |
| WO | WO 2020/191246 A1 | 9/2020 |
| WO | WO 2020/191248 A1 | 9/2020 |
| WO | WO 2020/191249 A1 | 9/2020 |
| WO | WO 2020/210751 A1 | 10/2020 |
| WO | WO 2020/214842 A1 | 10/2020 |
| WO | WO 2020/236982 A1 | 11/2020 |
| WO | WO 2020/247587 A1 | 12/2020 |
| WO | WO 2021/022043 A2 | 2/2021 |
| WO | WO 2021/025750 A1 | 2/2021 |
| WO | WO 2021/030666 A1 | 2/2021 |
| WO | WO 2021/042047 A1 | 3/2021 |
| WO | WO 2021/042062 A2 | 3/2021 |
| WO | WO 2021/072328 A1 | 4/2021 |
| WO | WO 2021/081264 A1 | 4/2021 |
| WO | WO 2021/087182 A1 | 5/2021 |
| WO | WO 2021/108717 A2 | 6/2021 |
| WO | WO 2021/138469 A1 | 7/2021 |
| WO | WO 2021/155065 A1 | 8/2021 |
| WO | WO 2021/158921 A2 | 8/2021 |
| WO | WO 2021/158995 A1 | 8/2021 |
| WO | WO 2021/158999 A1 | 8/2021 |
| WO | WO 2021/178709 A1 | 9/2021 |
| WO | WO 2021/178717 A2 | 9/2021 |
| WO | WO 2021/178720 A2 | 9/2021 |
| WO | WO 2021/178898 A1 | 9/2021 |
| WO | WO 2021/222318 A1 | 11/2021 |
| WO | WO 2021/226558 A1 | 11/2021 |

OTHER PUBLICATIONS

Huang et al., "Gain-of-function mutations in sodium channel NaV1.9 in painful neuropathy", Brain, 2014, vol. 137, pp. 1627-1642.*

Drenth & Waxman, "Mutations in sodium-channel gene SCN9A cause a spectrum of human genetic pain disorders", Science in Medicine, 2007, 117(12):3603-3609.*

Wu et al., "A Novel SCN9A Mutation Responsible for Primary Erythromelalgia and Is Resistant to the Treatment of Sodium Channel Blockers", Plos One, 2013, vol. 8, No. 1, e55212; pp. 1-15.*

OriGene Nav1.7(SCN9A)(NM_002977) Human Tagged ORF Clone. Retrived from < https://www.origene.com/catalog/cdna-clones/expression-plasmids/rc224884/nav17-scn9a-nm_002977-human-tagged-orf-clone > on Feb. 13, 2023.*

U.S. Appl. No. 61/716,256, filed Oct. 19, 2012, Jinek et al.
U.S. Appl. No. 61/717,324, filed Oct. 23, 2012, Cho et al.
U.S. Appl. No. 61/734,256, filed Dec. 6, 2012, Chen et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/794,422, filed Mar. 15, 2013, Knight et al.
U.S. Appl. No. 61/803,599, filed Mar. 20, 2013, Kim et al.
U.S. Appl. No. 61/837,481, filed Jun. 20, 2013, Cho et al.
U.S. Appl. No. 61/838,178, filed Jun. 21, 2013, Joung et al.
U.S. Appl. No. 61/874,682, filed Sep. 6, 2013, Liu et al.
U.S. Appl. No. 61/874,746, filed Sep. 6, 2013, Liu et al.
U.S. Appl. No. 62/288,661, filed Jan. 29, 2016, Muir et al.
U.S. Appl. No. 62/357,332, filed Jun. 30, 2016, Liu et al.

International Search Report for PCT/US2018/021664, dated Jun. 21, 2018.

International Preliminary Report on Patentability for PCT/US2018/021664, dated Sep. 19, 2019.

[No Author Listed] "FokI" from New England Biolabs Inc. Last accessed online via https://www.neb.com/products/r0109-foki#Product%20Information on Mar. 19, 2021. 1 page.

[No Author Listed] "Nucleic Acids Sizes and Molecular Weights." Printed Mar. 19, 2021. 2 pages.

[No Author Listed] "Zinc Finger Nuclease" from Wikipedia. Retrieved from https://en.wikipedia.org/w/index.php?title=Zinc_finger_nuclease&oldid=1007053318. Page last edited Feb. 16, 2021. Printed on Mar. 19, 2021.

[No Author Listed] Beast2: Bayesian evolutionary analysis by sampling trees. http://www.beast2.org/ Last accessed Apr. 28, 2021.

[No Author Listed] HyPhy—Hypothesis testing using Phylogenies. Last modified Apr. 21, 2017. Accessed online via http://hyphy.org/w/index.php/Main_Page on Apr. 28, 2021.

[No Author Listed] NCBI Accession No. XP_015843220.1. C→U editing enzyme APOBEC-1 [Peromyscus maniculatus bairdii], XP002793540. Mar. 21, 2016.

[No Author Listed] NCBI Accession No. XP_021505673.1. C→U editing enzyme APOBEC-1 [Meriones unguiculatus], XP002793541. Jun. 27, 2017.

[No Author Listed] NCBI Reference Sequence: WP_00087959824.1. Oct. 9, 2019. 2 pages.

[No Author Listed] NCBI Reference Sequence: WP_001516895.1. Mar. 13, 2021. 2 pages.

[No Author Listed] Nucleic Acid Data from New England Biolabs. Printed Sep. 28, 2021. 1 page.

[No Author Listed] Score result for SEQ 355 to WO2017032580. Muir et al. 2016.

(56) References Cited

OTHER PUBLICATIONS

[No Author Listed] Theoretical Biochemistry Group. Institute for Theoretical Chemistry. The ViennaRNA Package. Universitat Wien. https://www.tbi.univie.ac.at/RNA/. Last accessed Apr. 28, 2021.

[No Author Listed] Transcription activator-like effector nuclease. Wikipedia. Last edited Sep. 27, 2021. Accessed via https://en.wikipedia.org/w/index.php?title=Transcription_activator-like_effector_nuclease&oldid=1046813325 on Sep. 28, 2021. 9 pages.

[No Author Listed], "Human genome." Encyclopedia Britannica. Encyclopedia Brittanica, Inc. Published Feb. 15, 2019. Last accessed online via https://www.britannica.com/science/human-genome on Mar. 19, 2021. 2 pages.

[No Author Listed], EMBL Accession No. Q99ZW2. Nov. 2012. 2 pages.

[No Author Listed], Invitrogen Lipofectamine™ 2000 product sheets, 2002. 2 pages.

[No Author Listed], Invitrogen Lipofectamine™ 2000 product sheets, 2005. 3 pages.

[No Author Listed], Invitrogen Lipofectamine™ LTX product sheets, 2011. 4 pages.

[No Author Listed], Thermo Fisher Scientific—How Cationic Lipid Mediated Transfection Works, retrieved from the internet Aug. 27, 2015. 2 pages.

Abremski et al., Bacteriophage P1 site-specific recombination. Purification and properties of the Cre recombinase protein. J Biol Chem. Feb. 10, 1984;259(3):1509-14.

Abudayyeh et al., C2c2 is a single-component programmable RNA-guided RNA-targeting CRISPR effector. Science Aug. 2016;353(6299):aaf5573. DOI: 10.1126/science.aaf5573.

Abudayyeh et al., A cytosine deaminase for programmable single-base RNA editing. Science. Jul. 26, 2019;365(6451):382-386. doi: 10.1126/science.aax7063. Epub Jul. 11, 2019.

Abudayyeh et al., RNA targeting with CRISPR-Cas13. Nature. Oct. 12, 2017;550(7675):280-284. doi: 10.1038/nature24049. Epub Oct. 4, 2017.

Ada et al., Carbohydrate-protein conjugate vaccines. Clin Microbiol Infect. Feb. 2003;9(2):79-85. doi: 10.1046/j.1469-0691.2003.00530.x.

Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.

Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.

Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.

Adli, The CRISPR tool kit for genome editing and beyond. Nat Commun. May 15, 2018;9(1):1911. doi: 10.1038/s41467-018-04252-2.

Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.

Ahmad et al., Antibody-mediated specific binding and cytotoxicity of liposome-entrapped doxorubicin to lung cancer cells in vitro. Cancer Res. Sep. 1, 1992;52(17):4817-20.

Aida et al., Prime editing primarily incudes undesired outcomes in mice. bioRxiv preprint and Supplemental Information. Aug. 6, 2020. Retrieved from www.biorxiv.org. doi: 10.1101/2020.08.06.239723. 40 pages.

Aihara et al., A conformational switch controls the DNA cleavage activity of lambda integrase. Mol Cell. Jul. 2003;12(1):187-98.

Aik et al., Structure of human RNA ?-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.

Aird et al., Increasing Cas9-mediated homology-directed repair efficiency through covalent tethering of DNA repair template. Commun Biol. May 31, 2018;1:54. doi: 10.1038/s42003-018-0054-2.

Akcakaya et al., In vivo CRISPR editing with no detectable genome-wide off-target mutations. Nature. Sep. 2018;561(7723):416-419. doi: 10.1038/s41586-018-0500-9. Epub Sep. 12, 2018. PMID: 30209390; PMCID: PMC6194229.

Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.

Akinsheye et al., Fetal hemoglobin in sickle cell anemia. Blood. Jul. 7, 2011;118(1):19-27. doi: 10.1182/blood-2011-03-325258. Epub Apr. 13, 2011.

Akopian et al., Chimeric recombinases with designed DNA sequence recognition. Proc Natl Acad Sci U S A. Jul. 22, 2003;100(15):8688-91. Epub Jul. 1, 2003.

Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.

Alarcón et al., N6-methyladenosine marks primary microRNAs for processing. Nature. Mar. 26, 2015;519(7544):482-5. doi: 10.1038/nature14281. Epub Mar. 18, 2015.

Alexander, HFE-associated hereditary hemochromatosis. Genet Med. May 2009;11(5):307-13. doi: 10.1097/GIM.0b013e31819d30f2.

Alexandrov et al., Signatures of mutational processes in human cancer. Nature. Aug. 22, 2013;500(7463):415-21. doi: 10.1038/nature12477. Epub Aug. 14, 2013.

Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.

Altschul et al., Basic local alignment search tool. J Mol Biol. Oct. 5, 1990;215(3):403-10. doi: 10.1016/S0022-2836(05)80360-2.

Amato et al., Interpreting elevated fetal hemoglobin in pathology and health at the basic laboratory level: new and known γ-gene mutations associated with hereditary persistence of fetal hemoglobin. Int J Lab Hematol. Feb. 2014;36(1):13-9. doi: 10.1111/ijlh.12094. Epub Apr. 29, 2013.

Ames et al., A eubacterial riboswitch class that senses the coenzyme tetrahydrofolate. Chem Biol. Jul. 30, 2010;17(7):681-5. doi: 10.1016/j.chembiol.2010.05.020.

Amrann et al., Tightly regulated tac promoter vectors useful for the expression of unfused and fused proteins in *Escherichia coli*. Gene. Sep. 30, 1988;69(2):301-15.

Anders et al., Chapter One: In Vitro Enzymology of Cas9. in Methods in Enzymology, eds Doudna et al. 2014: 546:1-20.

Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.

Anderson, Human gene therapy. Science. May 8, 1992;256(5058):808-13. doi: 10.1126/science.1589762.

André et al., Axotomy-induced expression of calcium-activated chloride current in subpopulations of mouse dorsal root ganglion neurons. J Neurophysiol. Dec. 2003;90(6):3764-73. doi: 10.1152/jn.00449.2003. Epub Aug. 27, 2003.

Anzalone et al., Genome editing with CRISPR-Cas nucleases, base editors, transposases and prime editors. Nat Biotechnol. Jul. 2020;38(7):824-844. doi: 10.1038/s41587-020-0561-9. Epub Jun. 22, 2020.

Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.

Anzalone et al., Search-and-replace genome editing without double-strand breaks or donor DNA. Nature. Dec. 2019;576(7785):149-157. doi: 10.1038/s41586-019-1711-4. Epub Oct. 21, 2019.

Aplan, Causes of oncogenic chromosomal translocation. Trends Genet. Jan. 2006;22(1):46-55. doi: 10.1016/j.tig.2005.10.002. Epub Oct. 28, 2005.

Arakawa et al., A method to convert mRNA into a gRNA library for CRISPR/Cas9 editing of any organism. Sci Adv. Aug. 24, 2016;2(8):e1600699. doi: 10.1126/sciadv.1600699.

(56) References Cited

OTHER PUBLICATIONS

Araki et al., Comparative analysis of right element mutant lox sites on recombination efficiency in embryonic stem cells. BMC Biotechnol. Mar. 31, 2010;10:29. doi: 10.1186/1472-6750-10-29.
Araki et al., Site-specific recombinase, R, encoded by yeast plasmid pSR1. J Mol Biol. May 5, 1992;225(1):25-37. doi: 10.1016/0022-2836(92)91023-i.
Araki et al., Targeted integration of DNA using mutant lox sites in embryonic stem cells. Nucleic Acids Res. Feb. 15, 1997;25(4):868-72. doi: 10.1093/nar/25.4.868.
Arambula et al., Surface display of a massively variable lipoprotein by a Legionella diversity-generating retroelement. Proc Natl Acad Sci U S A. May 14, 2013;110(20):8212-7. doi: 10.1073/pnas.1301366110. Epub Apr. 30, 2013.
Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.
Arbab et al., Cloning-free CRISPR. Stem Cell Reports. Nov. 10, 2015;5(5):908-917. doi: 10.1016/j.stemcr.2015.09.022. Epub Oct. 29, 2015.
Arbab et al., Determinants of Base Editing Outcomes from Target Library Analysis and Machine Learning. Cell. Jul. 23, 2020;182(2):463-480.e30. doi: 10.1016/j.cell.2020.05.037. Epub Jun. 12, 2020.
Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.
Arnold et al., Mutants of Tn3 resolvase which do not require accessory binding sites for recombination activity. EMBO J. Mar. 1, 1999;18(5):1407-14.
Asante et al., A naturally occurring variant of the human prion protein completely prevents prion disease. Nature. Jun. 25, 2015;522(7557):478-81. doi: 10.1038/nature14510. Epub Jun. 10, 2015.
Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.
Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.
Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24.14731.
Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956.2001.02719.x.
Babacic et al., CRISPR-cas gene-editing as plausible treatment of neuromuscular and nucleotide-repeat-expansion diseases: A systematic review. PLoS One. Feb. 22, 2019;14(2):e0212198. doi: 10.1371/journal.pone.0212198.
Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.
Badran et al., Continuous evolution of Bacillus thuringiensis toxins overcomes insect resistance. Nature. May 5, 2016;533(7601):58-63. doi: 10.1038/nature17938. Epub Apr. 27, 2016.
Badran et al., Development of potent in vivo mutagenesis plasmids with broad mutational spectra. Nat Commun. Oct. 7, 2015;6:8425. doi: 10.1038/ncomms9425.
Bae et al., Cas-OFFinder: a fast and versatile algorithm that searches for potential off-target sites of Cas9 RNA-guided endonucleases. Bioinformatics. May 15, 2014;30(10):1473-5. doi: 10.1093/bioinformatics/btu048. Epub Jan. 24, 2014.
Bae et al., Microhomology-based choice of Cas9 nuclease target sites. Nat Methods. Jul. 2014;11(7):705-6. doi: 10.1038/nmeth.3015.

Bagal et al., Recent progress in sodium channel modulators for pain. Bioorg Med Chem Lett. Aug. 15, 2014;24(16):3690-9. doi: 10.1016/j.bmcl.2014.06.038. Epub Jun. 21, 2014.
Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.
Balakrishnan et al., Flap endonuclease 1. Annu Rev Biochem. 2013;82:119-38. doi: 10.1146/annurev-biochem-072511-122603. Epub Feb. 28, 2013.
Baldari et al., A novel leader peptide which allows efficient secretion of a fragment of human interleukin 1 beta in *Saccharomyces cerevisiae*. EMBO J. Jan. 1987;6(1):229-34.
Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi:10.1093/nar/gki291.
Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.
Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.
Baranauskas et al., Generation and characterization of new highly thermostable and processive M-MuLV reverse transcriptase variants. Protein Eng Des Sel. Oct. 2012;25(10):657- 68. doi: 10.1093/protein/gzs034. Epub Jun. 12, 2012.
Barmania et al., C—C chemokine receptor type five (CCR5): An emerging target for the control of HIV infection. Appl Transl Genom. May 26, 2013;2:3-16. doi: 10.1016/j.atg.2013.05.004.
Barnes et al., Repair and genetic consequences of endogenous DNA base damage in mammalian cells. Annu Rev Genet. 2004;38:445-76.
Barnes et al., The fidelity of Taq polymerase catalyzing PCR is improved by an—terminal deletion. Gene. Mar. 1, 1992;112(1):29-35. doi: 10.1016/0378-1119(92)90299-5.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.
Bartosovic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Basturea et al., Substrate specificity and properties of the *Escherichia coli* 16S rRNA methyltransferase, RsmE. RNA. Nov. 2007;13(11):1969-76. doi: 10.1261/rna.700507. Epub Sep. 18, 2007.
Batey et al., Structure of a natural guanine-responsive riboswitch complexed with the metabolite hypoxanthine. Nature. Nov. 18, 2004;432(7015):411-5.
Beale et al., Comparison of the differential context-dependence of DNA deamination by APOBEC enzymes: correlation with mutation spectra in vivo. J Mol Biol. Mar. 26, 2004;337(3):585-96.
Beaudry et al., Directed evolution of an RNA enzyme. Science. Jul. 31, 1992;257(5070):635-41. doi: 10.1126/science.1496376.
Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.
Bedell et al., In vivo genome editing using a high-efficiency TALEN system. Nature. Nov. 1, 2012;491(7422):114-8. Doi: 10.1038/nature11537. Epub Sep. 23, 2012.

(56) References Cited

OTHER PUBLICATIONS

Begley, Scientists unveil the 'most clever CRISPR gadget' so far. STAT, Apr. 20, 2016. https://www.statnews.com/2016/04/20/clever-crispr-advance-unveiled/.

Behr, Gene transfer with synthetic cationic amphiphiles: prospects for gene therapy. Bioconjug Chem. Sep.-Oct. 1994;5(5):382-9. doi: 10.1021/bc00029a002.

Bell et al., Ribozyme-catalyzed excision of targeted sequences from within RNAs. Biochemistry. Dec. 24, 2002;41(51):15327-33. doi: 10.1021/bi0267386.

Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.

Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.

Benarroch, HCN channels: function and clinical implications. Neurology. Jan. 15, 2013;80(3):304-10. doi: 10.1212/WNL. 0b013e31827dec42.

Bennett et al., Painful and painless channelopathies. Lancet Neurol. Jun. 2014;13(6):587-99. doi: 10.1016/S1474-4422(14)70024-9. Epub May 6, 2014.

Bentin, T., A ribozyme transcribed by a ribozyme. Artif DNA PNA XNA. Apr. 2011;2(2):40-42. doi: 10.4161/adna.2.2.16852.

Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.

Berges et al., Transduction of brain by herpes simplex virus vectors. Mol Ther. Jan. 2007;15(1):20-9. doi: 10.1038/sj.mt.6300018.

Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375. 1999.

Bernhart et al., Local RNA base pairing probabilities in large sequences. Bioinformatics. Mar. 1, 2006;22(5):614-5. doi: 10.1093/bioinformatics/btk014. Epub Dec. 20, 2005.

Bernstein et al., Role for a bidentate ribonuclease in the initiation step of RNA interference. Nature. Jan. 18, 2001;409(6818):363-6. doi: 10.1038/35053110.

Bershtein et al., Advances in laboratory evolution of enzymes. Curr Opin; Chem Biol. Apr. 2008;12(2):151-8. doi: 10.1016/j.cbpa.2008. 01.027. Epub Mar. 7, 2008. Review.

Bertolotti et al., Toward genosafe endonuclease-boosted gene targeting using breakthrough CRISP/Cas9 for next generation stem cell gene therapy culminating in efficient ex Vivo in Vivo gene repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.

Bertrand et al., Localization of ASH1 mRNA particles in living yeast. Mol Cell. Oct. 1998;2(4):437-45. doi: 10.1016/s1097-2765(00)80143-4.

Bessen et al., High-resolution specificity profiling and off-target prediction for site-specific DNA recombinases. Nat Commun. Apr. 26, 2019;10(1):1937. doi: 10.1038/s41467-019-09987-0.

Beumer et al., Efficient gene targeting in Drosophila with zinc-finger nucleases. Genetics. Apr. 2006;172(4):2391-403. Epub Feb. 1, 2006.

Bhagwat, DNA-cytosine deaminases: from antibody maturation to antiviral defense. DNA Repair (Amst). Jan. 5, 2004;3(1):85-9.

Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.

Bibb et al., Integration and excision by the large serine recombinase phiRv1 integrase. Mol Microbiol. Mar. 2005;55(6):1896-910. doi: 10.1111/j.1365-2958.2005.04517.x.

Biehs et al., DNA Double-Strand Break Resection Occurs during Non-homologous End Joining in G1 but Is Distinct from Resection during Homologous Recombination. Mol Cell. Feb. 16, 2017;65(4):671-684.e5. doi: 10.1016/j.molcel.2016.12.016. Epub Jan. 26, 2017.

Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel. 2017.08.008. Epub Sep. 7, 2017.

Birling et al., Site-specific recombinases for manipulation of the mouse genome. Methods Mol Biol. 2009;561:245-63. doi: 10.1007/978-1-60327-019-9_16.

Biswas et al., A structural basis for allosteric control of DNA recombination by lambda integrase. Nature. Jun. 23, 2005;435(7045):1059-66. doi: 10.1038/nature03657.

Bitinaite et al., FokI dimerization is required for DNA cleavage. Proc Natl Acad Sci U S A. Sep. 1, 1998;95(18):10570-5.

Blaese et al., Vectors in cancer therapy: how will they deliver? Cancer Gene Ther. Dec. 1995;2(4):291-7.

Blain et al., Nuclease activities of Moloney murine leukemia virus reverse transcriptase. Mutants with altered substrate specificities. J Biol Chem. Nov. 5, 1993;268(31):23585-92.

Blaisonneau et al., A circular plasmid from the yeast *Torulaspora delbrueckii*. Plasmid. 1997;38(3):202-9. doi: 10.1006/plas.1997. 1315.

Blau et al., A proliferation switch for genetically modified cells. PNAS Apr. 1, 1997 94 (7) 3076-3081; https://doi.org/10.1073/pnas. 94.7.3076.

Bloom et al., Evolving strategies for enzyme engineering. Curr Opin Struct Biol. Aug. 2005;15(4):447-52.

Boch, Tales of genome targeting. Nat Biotechnol. Feb. 2011;29(2):135-6. Doi: 10.1038/nbt.1767.

Bodi et al., Yeast m6A Methylated mRNAs Are Enriched on Translating Ribosomes during Meiosis, and under Rapamycin Treatment. PLoS One. Jul. 17, 2015;10(7):e0132090. doi: 10.1371/journal. pone.0132090.

Boeckle et al., Melittin analogs with high lytic activity at endosomal pH enhance transfection with purified targeted PEI polyplexes. J Control Release. May 15, 2006;112(2):240-8. Epub Mar. 20, 2006.

Boersma et al., Selection strategies for improved biocatalysts. FEBS J. May 2007;274(9):2181-95.

Bogdanove et al., Engineering altered protein-DNA recognition specificity. Nucleic Acids Res. Jun. 1, 2018;46(10):4845-4871. doi: 10.1093/nar/gky289.

Bogdanove et al., TAL effectors: customizable proteins for DNA targeting. Science. Sep. 30, 2011;333(6051):1843-6. doi: 10.1126/science.1204094.

Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.

Bolotin et al., Clustered regularly interspaced short palindrome repeats (CRISPRs) have spacers of extrachromosomal origin. Microbiology. Aug. 2005;151(Pt 8):2551-61.

Bolusani et al., Evolution of variants of yeast site-specific recombinase Flp that utilize native genomic sequences as recombination target sites. Nucleic Acids Res. 2006;34(18):5259-69. Epub Sep. 26, 2006.

Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.

Borchardt et al., Controlling mRNA stability and translation with the CRISPR endoribonuclease Csy4. RNA. Nov. 2015;21(11):1921-30. doi: 10.1261/rna.051227.115. Epub Sep. 9, 2015.

Borman, Improved route to single-base genome editing. Chemical & Engineering News, Apr. 25, 2016;94(17)p5. http://cen.acs.org/articles/94/i17/Improved-route-single-base-genome.html.

Bourinet et al., Silencing of the Cav3.2 T-type calcium channel gene in sensory neurons demonstrates its major role in nociception. EMBO J. Jan. 26, 2005;24(2):315-24. doi: 10.1038/sj.emboj. 7600515. Epub Dec. 16, 2004.

(56) References Cited

OTHER PUBLICATIONS

Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.

Box et al., A multi-domain protein system based on the HC fragment of tetanus toxin for targeting DNA to neuronal cells. J Drug Target. Jul. 2003;11(6):333-43. doi: 10.1080/10611863100001634667.

Branden and Tooze, Introduction to Protein Structure. 1999; 2nd edition. Garland Science Publisher: 3-12.

Braun et al., Immunogenic duplex nucleic acids are nuclease resistant. J Immunol. Sep. 15, 1988;141(6):2084-9.

Briner et al., Guide RNA functional modules direct Cas9 activity and orthogonality. Mol Cell. Oct. 23, 2014;56(2):333-339. doi: 10.1016/j.molcel.2014.09.019.

Britt et al., Re-engineering plant gene targeting. Trends Plant Sci. Feb. 2003;8(2):90-5.

Brouns et al., Small CRISPR RNAs guide antiviral defense in prokaryotes. Science. Aug. 15, 2008;321(5891):960-4. doi: 10.1126/science.1159689.

Brown et al., A mammalian protein targeted by G1-arresting rapamycin-receptor complex. Nature. Jun. 30, 1994;369(6483):756-8. doi: 10.1038/369756a0.

Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.

Brown et al., Serine recombinases as tools for genome engineering. Methods. Apr. 2011;53(4):372-9. doi: 10.1016/j.ymeth.2010.12.031. Epub Dec. 30, 2010.

Brown et al., Structural insights into the stabilization of MALAT1 noncoding RNA by a bipartite triple helix. Nat Struct Mol Biol. Jul. 2014;21(7):633-40. doi: 10.1038/nsmb.2844. Epub Jun. 22, 2014.

Brusse et al., Spinocerebellar ataxia associated with a mutation in the fibroblast growth factor 14 gene (SCA27): A new phenotype. Mov Disord. Mar. 2006;21(3):396-401.

Brzezicha et al., Identification of human tRNA:m5C methyltransferase catalysing intron-dependent m5C formation in the first position of the anticodon of the pre-tRNA Leu (CAA). Nucleic Acids Res. 2006;34(20):6034-43. doi: 10.1093/nar/gkl765. Epub Oct. 27, 2006.

Buchholz et al., Alteration of Cre recombinase site specificity by substrate-linked protein evolution. Nat Biotechnol. Nov. 2001;19(11):1047-52.

Buchschacher et al., Human immunodeficiency virus vectors for inducible expression of foreign genes. J Virol. May 1992;66(5):2731-9. doi: 10.1128/JVI.66.5.2731-2739.1992.

Buchwald et al., Long-term, continuous intravenous heparin administration by an implantable infusion pump in ambulatory patients with recurrent venous thrombosis. Surgery. Oct. 1980;88(4):507-16.

Buckley et al., Targeting the von Hippel-Lindau E3 ubiquitin ligase using small molecules to disrupt the VHL/HIF-1? interaction. J Am Chem Soc. Mar. 14, 2012;134(10):4465-8. doi: 10.1021/ja209924v. Epub Feb. 27, 2012.

Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.

Budker et al., Protein/amphipathic polyamine complexes enable highly efficient transfection with minimal toxicity. Biotechniques. Jul. 1997;23(1):139, 142-7. doi: 10.2144/97231n-02.

Budworth et al., A brief history of triplet repeat diseases. Methods Mol Biol. 2013;1010:3-17. doi: 10.1007/978-1-62703-411-1_1.

Bulow et al., Multienzyme systems obtained by gene fusion. Trends Biotechnol. Jul. 1991;9(7):226-31.

Burke et al., Activating mutations of Tn3 resolvase marking interfaces important in recombination catalysis and its regulation. Mol Microbiol. Feb. 2004;51(4):937-48.

Burke et al., RNA Aptamers to the Adenosine Moiety of S-adenosyl Methionine: Structural Inferences From Variations on a Theme and the Reproducibility of Selex. Nucleic Acids Res. May 15, 1997;25(10):2020-4. doi: 10.1093/nar/25.10.2020.

Burstein et al., New CRISPR-Cas systems from uncultivated microbes. Nature Feb. 2017;542(7640):237-240.

Burton et al., Gene delivery using herpes simplex virus vectors. DNA Cell Biol. Dec. 2002;21(12):915-36. doi: 10.1089/104454902762053864.

Buskirk et al., Directed evolution of ligand dependence: small-molecule-activated protein splicing. Proc Natl Acad Sci U S A. Jul. 20, 2004;101(29):10505-10. Epub Jul. 9, 2004.

Buskirk et al., In vivo evolution of an RNA-based transcriptional activator. Chem Biol. Jun. 2003;10(6):533-40. doi: 10.1016/s1074-5521(03)00109-1.

Butt et al., Efficient CRISPR/Cas9-Mediated Genome Editing Using a Chimeric Single-Guide RNA Molecule. Front Plant Sci. Aug. 24, 2017;8:1441(1-8). doi: 10.3389/fpls.2017.01441.

Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.

Böck et al., Selenocysteine: the 21st amino acid. Mol Microbiol. Mar. 1991;5(3):515-20.

Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.

Cadwell et al., Randomization of genes by PCR mutagenesis. PCR Methods Appl. Aug. 1992;2(1):28-33. doi: 10.1101/gr.2.1.28.

Cai et al., Reconstruction of ancestral protein sequences and its applications. BMC Evol Biol. Sep. 17, 2004;4:33. doi: 10.1186/1471-2148-4-33.

Calame et al., Transcriptional controlling elements in the immunoglobulin and T cell receptor loci. Adv Immunol. 1988;43:235-75. doi: 10.1016/s0065-2776(08)60367-3.

Caldecott et al., Single-strand break repair and genetic disease. Nat Rev Genet. Aug. 2008;9(8):619-31. doi: 10.1038/nrg2380.

Camarero et al., Biosynthesis of a Head-to-Tail Cyclized Protein with Improved Biological Activity. J. Am. Chem. Soc. May 29, 1999;121(23):5597-5598. https://doi.org/10.1021/ja990929n.

Cameron, Recent advances in transgenic technology. Mol Biotechnol. Jun. 1997;7(3):253-65.

Camper et al., Postnatal repression of the alpha-fetoprotein gene is enhancer independent. Genes Dev. Apr. 1989;3(4):537-46. doi: 10.1101/gad.3.4.537.

Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.

Canchaya et al., Genome analysis of an inducible prophage and prophage remnants integrated in the *Streptococcus pyogenes* strain SF370. Virology. Oct. 25, 2002;302(2):245-58. doi: 10.1006/viro.2002.1570.

Canver et al., Customizing the genome as therapy for the ?-hemoglobinopathies. Blood. May 26, 2016;127(21):2536-45. doi: 10.1182/blood-2016-01-678128. Epub Apr. 6, 2016.

Cargill et al., Characterization of single-nucleotide polymorphisms in coding regions of human genes. Nat Genet. Jul. 1999;22(3):231-8.

Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.

Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.

Caron et al., Intracellular delivery of a Tat-eGFP fusion protein into muscle cells. Mol Ther. Mar. 2001;3(3):310-8.

Carr et al., Genome engineering. Nat Biotechnol. Dec. 2009;27(12):1151-62. doi: 10.1038/nbt.1590.

Carroll et al., Gene targeting in *Drosophila* and *Caenorhabditis elegans* with zinc-finger nucleases. Methods Mol Biol. 2008;435:63-77. doi: 10.1007/978-1-59745-232-8_5.

Carroll et al., Progress and prospects: zinc-finger nucleases as gene therapy agents. Gene Ther. Nov. 2008;15(22):1463-8. doi: 10.1038/gt.2008.145. Epub Sep. 11, 2008.

(56) References Cited

OTHER PUBLICATIONS

Carroll, A CRISPR approach to gene targeting. Mol Ther. Sep. 2012;20(9):1658-60. doi: 10.1038/mt.2012.171.

Carroll, Genome engineering with zinc-finger nucleases. Genetics. Aug. 2011;188(4):773-82. doi: 10.1534/genetics.111.131433. Review.

Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.

Caspi et al., Distribution of split DnaE inteins in cyanobacteria. Mol Microbiol. Dec. 2003;50(5):1569-77. doi: 10.1046/j.1365-2958.2003.03825.x.

Cattaneo et al., SEL1L affects human pancreatic cancer cell cycle and invasiveness through modulation of PTEN and genes related to cell-matrix interactions. Neoplasia. 2005;7(11):1030-1038.

Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.

Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.

Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.

Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.

Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.

Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.

Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.

Chan et al., Molecular recording of mammalian embryogenesis. Nature. Jun. 2019;570(7759):77-82. doi: 10.1038/s41586-019-1184-5. Epub May 13, 2019.

Chan et al., Novel selection methods for DNA-encoded chemical libraries. Curr Opin Chem Biol. 2015;26:55-61. doi:10.1016/j.cbpa.2015.02.010.

Chan et al., The choice of nucleotide inserted opposite abasic sites formed within chromosomal DNA reveals the polymerase activities participating in translesion DNA synthesis. DNA Repair (Amst). Nov. 2013;12(11):878-89. doi: 10.1016/j.dnarep.2013.07.008. Epub Aug. 26, 2013.

Chapman et al., Playing the end game: DNA double-strand break repair pathway choice. Mol Cell. Aug. 24, 2012;47(4):497-510. doi: 10.1016/j.molcel.2012.07.029.

Chari et al., Unraveling CRISPR-Cas9 genome engineering parameters via a library-on-library approach. Nat Methods. Sep. 2015;12(9):823-6. doi: 10.1038/nmeth.3473. Epub Jul. 13, 2015.

Charpentier et al., Biotechnology: Rewriting a genome. Nature. Mar. 7, 2013;495(7439):50-1. doi: 10.1038/495050a.

Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.

Chavez et al., Highly efficient Cas9-mediated transcriptional programming. Nat Methods. Apr. 2015;12(4):326-8. doi: 10.1038/nmeth.3312. Epub Mar. 2, 2015.

Chavez et al., Precise Cas9 targeting enables genomic mutation prevention. bioRxiv. Jun. 14, 2016; http://dx/doi.oreg/10.1101/058974. 6 pages. bioRxiv preprint first posted online Jun. 14, 2016.

Chavez et al., Precise Cas9 targeting enables genomic mutation prevention. Proc Natl Acad Sci U S A. Apr. 3, 2018;115(14):3669-3673. doi: 10.1073/pnas.1718148115. Epub Mar. 19, 2018. bioRxiv preprint first posted online Jun. 14, 2016.

Chavez et al., Therapeutic applications of the ?C31 integrase system. Curr Gene Ther. Oct. 2011;11(5):375-81. Review.

Chawla et al., An atlas of RNA base pairs involving modified nucleobases with optimal geometries and accurate energies. Nucleic Acids Res. Aug. 18, 2015;43(14):6714-29. doi: 10.1093/nar/gkv606. Epub Jun. 27, 2015.

Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.

Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.

Chen et al., Enhanced proofreading governs CRISPR-Cas9 targeting accuracy. Nature. Oct. 19, 2017;550(7676):407-410. doi: 10.1038/nature24268. Epub Sep. 20, 2017.

Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.

Chen et al., Fusion protein linkers: property, design and functionality. Adv Drug Deliv Rev. Oct. 2013;65(10):1357-69. doi: 10.1016/j.addr.2012.09.039. Epub Sep. 9, 2012.

Chen et al., Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.

Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.

Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.

Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.

Chen et al., Targeting genomic rearrangements in tumor cells through Cas9-mediated insertion of a suicide gene. Nat Biotechnol. Jun. 2017;35(6):543-550. doi: 10.1038/nbt.3843. Epub May 1, 2017.

Cheng et al., Multiplexed activation of endogenous genes by CRISPR-on, an RNA-guided transcriptional activator system. Cell Res. Oct. 2013;23(10):1163-71. doi: 10.1038/cr.2013.122. Epub Aug. 27, 2013.

Chesnoy et al., Structure and function of lipid-DNA complexes for gene delivery. Annu Rev Biophys Biomol Struct. 2000;29:27-47.

Chester et al., The apolipoprotein B mRNA editing complex performs a multifunctional cycle and suppresses nonsense-mediated decay. EMBO J. Aug. 1, 2003;22(15):3971-82. doi: 10.1093/emboj/cdg369.

Chew et al., A multifunctional AAV-CRISPR-Cas9 and its host response. Nat Methods. Oct. 2016;13(10):868-74. doi: 10.1038/nmeth.3993. Epub Sep. 5, 2016.

Chew et al., A multifunctional AAV-CRISPR-Cas9 and its host response. Nat Methods. Oct. 2016;13(10):868-74. doi: 10.1038/nmeth.3993. Epub Sep. 5, 2016. Supplementary Information.

Chichili et al., Linkers in the structural biology of protein-protein interactions. Protein Science. 2013;22:153-67.

Chin, Expanding and reprogramming the genetic code of cells and animals. Annu Rev Biochem. 2014;83:379-408. doi: 10.1146/annurev-biochem-060713-035737. Epub Feb. 10, 2014.

Chipev et al., A leucine—proline mutation in the H1 subdomain of keratin 1 causes epidermolytic hyperkeratosis. Cell. Sep. 4, 1992;70(5):821-8.

(56) References Cited

OTHER PUBLICATIONS

Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Cho et al., Site-specific recombination of bacteriophage P22 does not require integration host factor. J Bacteriol. Jul. 1999;181(14):4245-9. doi: 10.1128/JB.181.14.4245-4249.1999.
Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.
Cho et al., The calcium-activated chloride channel anoctamin 1 acts as a heat sensor in nociceptive neurons. Nat Neurosci. May 27, 2012;15(7):1015-21. doi: 10.1038/nn.3111.
Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.
Choi et al., (6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.
Choi et al., Protein trans-splicing and characterization of a split family B-type DNA polymerase from the hyperthermophilic archaeal parasite Nanoarchaeum equitans. J Mol Biol. Mar. 10, 2006;356(5):1093-106. doi: 10.1016/j.jmb.2005.12.036. Epub Dec. 27, 2005.
CHOI et at al., Translesion synthesis across abasic lesions by human B-family and Y-family DNA polymerases ?, ?, ?, ?, ?, and Rev1. J Mol Biol. Nov. 19, 2010;404(1):34-44. doi: 10.1016/j.jmb.2010.09.015. Epub Oct. 1, 2010.
Chong et al., Modulation of protein splicing of the *Saccharomyces cerevisiae* vacuolar membrane ATPase intein. J Biol Chem. Apr. 24, 1998;273(17):10567-77. doi: 10.1074/jbc.273.17.10567.
Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.
Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.
Chong et al., Protein splicing of the *Saccharomyces cerevisiae* VMA intein without the endonuclease motifs. J Biol Chem. Jun. 20, 1997;272(25):15587-90. doi: 10.1074/jbc.272.25.15587.
Chong et al., Single-column purification of free recombinant proteins using a self-cleavable affinity tag derived from a protein splicing element. Gene. Jun. 19, 1997;192(2):271-81. doi: 10.1016/s0378-1119(97)00105-4.
Choudhury et al., CRISPR-dCas9 mediated TET1 targeting for selective DNA demethylation at BRCA1 promoter. Oncotarget. Jul. 19, 2016;7(29):46545-46556. doi: 10.18632/oncotarget.10234.
Choudhury et al., Engineering RNA endonucleases with customized sequence specificities. Nat Commun. 2012;3:1147. doi: 10.1038/ncomms2154.
Choulika et al., Induction of homologous recombination in mammalian chromosomes by using the I-SceI system of *Saccharomyces cerevisiae*. Mol Cell Biol. Apr. 1995;15(4):1968-73. doi: 10.1128/MCB.15.4.1968.
Christian et al., Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. Doi: 10.1534/genetics.110.120717. Epub Jul. 26, 2010.
Christiansen et al., Characterization of the lactococcal temperate phage TP901-1 and its site-specific integration. J Bacteriol. Feb. 1994;176(4):1069-76. doi: 10.1128/jb.176.4.1069-1076.1994.
Chu et al., Increasing the efficiency of homology-directed repair for CRISPR-Cas9-induced precise gene editing in mammalian cells. Nat Biotech. Feb. 13, 2015;33:543-8.
Chu et al., Increasing the efficiency of homology-directed repair for CRISPR-Cas9-induced precise gene editing in mammalian cells. Nat Biotech. Feb. 13, 2015;33:543-8. doi: 10.1038/nbt.3198. Epub Mar. 24, 2015.
Chuai et al., DeepCRISPR: optimized CRISPR guide RNA design by deep learning. Genome Biol. Jun. 26, 2018;19(1):80. doi: 10.1186/s13059-018-1459-4.
Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.
Chuang et al., Novel Heterotypic Rox Sites for Combinatorial Dre Recombination Strategies. G3 (Bethesda). Dec. 29, 2015;6(3):559-71. doi: 10.1534/g3.115.025841.
Chujo et al., Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 24, 2012.
Chung-II et al., Artificial control of gene expression in mammalian cells by modulating RNA interference through aptamer-small molecule interaction. RNA. May 2006;12(5):710-6. Epub Apr. 10, 2006.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Clackson et al., Redesigning an FKBP-ligand interface to generate chemical dimerizers with novel specificity. Proc Natl Acad Sci U S A. Sep. 1, 1998;95(18):10437-42. doi: 10.1073/pnas.95.18.10437.
Clement et al., CRISPResso2 provides accurate and rapid genome editing sequence analysis. Nat Biotechnol. Mar. 2019;37(3):224-226. doi: 10.1038/s41587-019-0032-3.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
Cokol et al., Finding nuclear localization signals. EMBO Rep. Nov. 2000;1(5):411-5. doi: 10.1093/embo-reports/kvd092.
Cole et al., Reconstructing evolutionary adaptive paths for protein engineering. Methods Mol Biol. 2013;978:115-25. doi: 10.1007/978-1-62703-293-3_8.
Cole-Strauss et al., Correction of the mutation responsible for sickle cell anemia by an RNA-DNA oligonucleotide. Science. Sep. 6, 1996;273(5280):1386-9.
Collinge, Prion diseases of humans and animals: their causes and molecular basis. Annu Rev Neurosci. 2001;24:519-50. doi: 10.1146/annurev.neuro.24.1.519.
Cong et al., Multiplex genome engineering using CRISPR/Cas systems. Science. Feb. 15, 2013;339(6121):819-23. doi: 10.1126/science.1231143. Epub Jan. 3, 2013.
Conrad et al., A Kaposi's sarcoma virus RNA element that increases the nuclear abundance of intronless transcripts. EMBO J. May 18, 2005;24(10):1831-41. doi: 10.1038/sj.emboj.7600662. Epub Apr. 28, 2005.
Conticello, The AID/APOBEC family of nucleic acid mutators. Genome Biol. 2008;9(6):229. doi: 10.1186/gb-2008-9-6-229. Epub Jun. 7, 2008.
Cornu et al., Refining strategies to translate genome editing to the clinic. Nat Med. Apr. 3, 2017;23(4):415-423. doi: 10.1038/nm.4313.
Costa et al., Frequent use of the same tertiary motif by self-folding RNAs. EMBO J. Mar. 15, 1995;14(6):1276-85.
Cotton et al., Insertion of a Synthetic Peptide into a Recombinant Protein Framework: A Protein Biosensor. J. Am. Chem. Soc. Jan. 22, 1999;121(5):1100-1. https://doi.org/10.1021/ja983804b.
Covino et al., The CCL2/CCR2 Axis in the Pathogenesis of HIV-1 Infection: A New Cellular Target for Therapy? Current Drug Targets Dec. 2016;17(1):76-110. DOI: 10.2174/1389450117011512171109917.
Cox et al., An SCN9A channelopathy causes congenital inability to experience pain. Nature. Dec. 14, 2006;444(7121):894-8. doi: 10.1038/nature05413.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.

(56) References Cited

OTHER PUBLICATIONS

Cox et al., Congenital insensitivity to pain: novel SCN9A missense and in-frame deletion mutations. Hum Mutat. Sep. 2010;31(9):E1670-86. doi: 10.1002/humu.21325.
Cox et al., RNA editing with CRISPR-Cas13. Science. Nov. 24, 2017;358(6366):1019-1027. doi: 10.1126/science.aaq0180. Epub Oct. 25, 2017.
Cox et al., Therapeutic genome editing: prospects and challenges. Nat Med. Feb. 2015;21(2):121-31. doi: 10.1038/nm.3793.
Cox, Proteins pinpoint double strand breaks. Elife. Oct. 29, 2013;2:e01561. doi: 10.7554/eLife.01561.
Crabtree et al., Three-part inventions: intracellular signaling and induced proximity. Trends Biochem Sci. Nov. 1996;21(11):418-22. doi: 10.1016/s0968-0004(96)20027-1.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Crick, On protein synthesis. Symp Soc Exp Biol. 1958;12:138-63.
Cronican et al., A class of human proteins that deliver functional proteins into mammalian cells in vitro and in vivo. Chem Biol. Jul. 29, 2011;18(7):833-8. doi: 10.1016/j.chembiol.2011.07.003.
Cronican et al., Potent delivery of functional proteins into Mammalian cells in vitro and in vivo using a supercharged protein. ACS Chem Biol. Aug. 20, 2010;5(8):747-52. doi:10.1021/cb1001153.
Crystal, Transfer of genes to humans: early lessons and obstacles to success. Science. Oct. 20, 1995;270(5235):404-10. doi: 10.1126/science.270.5235.404.
Cui et al., Consequences of Cas9 cleavage in the chromosome of *Escherichia coli*. Nucleic Acids Res. May 19, 2016;44(9):4243-51. doi: 10.1093/nar/gkw223. Epub Apr. 8, 2016.
Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.celrep.2017.02.059.
Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gku1010. Epub Oct. 28, 2014.
Cupples et al., A set of lacZ mutations in *Escherichia coli* that allow rapid detection of each of the six base substitutions. Proc Natl Acad Sci U S A. Jul. 1989;86(14):5345-9.
D'Adda di Fagagna et al., The Gam protein of bacteriophage Mu is an orthologue of eukaryotic Ku. EMBO Rep. Jan. 2003;4(1):47-52.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Dahlgren et al., A novel mutation in ribosomal protein S4 that affects the function of a mutated RF1. Biochimie. Aug. 2000;82(8):683-91.
Dahlman et al., Orthogonal gene knockout and activation with a catalytically active Cas9 nuclease. Nat Biotechnol. Nov. 2015;33(11):1159-61. doi: 10.1038/nbt.3390.
Dandage et al., beditor: A Computational Workflow for Designing Libraries of Guide RNAs for CRISPR-Mediated Base Editing. Genetics. Jun. 2019;212(2):377-385. doi: 10.1534/genetics.119.302089. Epub Apr. 1, 2019.

Dang et al., Optimizing sgRNA structure to improve CRISPR-Cas9 knockout efficiency. Genome Biol. Dec. 15, 2015;16:280. doi: 10.1186/s13059-015-0846-3.
Das et al., The crystal structure of the monomeric reverse transcriptase from Moloney murine leukemia virus. Structure. May 2004;12(5):819-29. doi: 10.1016/j.str.2004.02.032.
Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.
Dassa et al., Trans protein splicing of cyanobacterial split inteins in endogenous and exogenous combinations. Biochemistry. Jan. 9, 2007;46(1):322-30. doi: 10.1021/bi0611762.
Database EBI Accession No. ADE34233 Jan. 29, 2004.
Database EBI Accession No. BFF09785. May 31, 2018. 2 pages.
Database EBI Accession No. BGE38086. Jul. 25, 2019. 2 pages.
Database UniProt Accession No. G8I3E0. Jan. 14, 2012.
Datsenko et al., One-step inactivation of chromosomal genes in *Escherichia coli* K-12 using PCR products. Proc Natl Acad Sci U S A. Jun. 6, 2000;97(12):6640-5.
Davidson et al., Viral vectors for gene delivery to the nervous system. Nat Rev Neurosci. May 2003;4(5):353-64. doi: 10.1038/nrn1104.
Davis et al., DNA double strand break repair via non-homologous end-joining. Transl Cancer Res. Jun. 2013;2(3):130-143.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
De Felipe et al., Co-translational, intraribosomal cleavage of polypeptides by the foot-and-mouth disease virus 2A peptide. J Biol Chem. Mar. 28, 2003;278(13):11441-8. doi: 10.1074/jbc.M211644200. Epub Jan. 8, 2003.
De La Peña et al., The Hammerhead Ribozyme: A Long History for a Short RNA. Molecules. Jan. 4, 2017;22(1):78. doi: 10.3390/molecules22010078.
De Souza, Primer: genome editing with engineered nucleases. Nat Methods. Jan. 2012;9(1):27.
De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.
Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, Alive Study. Science. Sep. 27, 1996;273(5283):1856-62. doi: 10.1126/science.273.5283.1856.
DeKosky et al., Large-scale sequence and structural comparisons of human naive and antigen-experienced antibody repertoires. Proc Natl Acad Sci U S A. May 10, 2016;113(19):E2636-45. doi: 10.1073/pnas.1525510113. Epub Apr. 25, 2016.
Delebecque et al., Organization of intracellular reactions with rationally designed RNA assemblies. Science. Jul. 22, 2011;333(6041):470-4. doi: 10.1126/science.1206938. Epub Jun. 23, 2011.
Deltcheva et al., CRISPR RNA maturation by trans-encoded small RNA and host factor RNase III. Nature. Mar. 31, 2011;471(7340):602-7. doi: 10.1038/nature09886.
Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.
Denizio et al., Harnessing natural DNA modifying activities for editing of the genome and epigenome. Curr Opin Chem Biol. Aug. 2018;45:10-17. doi: 10.1016/j.cbpa.2018.01.016. Epub Feb. 13, 2018.
Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.
Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.

(56) References Cited

OTHER PUBLICATIONS

Dever et al., CRISPR/Cas9 ?-globin gene targeting in human haematopoietic stem cells. Nature. Nov. 17, 2016;539(7629):384-389. doi: 10.1038/nature20134. Epub Nov. 7, 2016.
Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.
Devigili et al., Paroxysmal itch caused by gain-of-function Nav1.7 mutation. Pain. Sep. 2014;155(9):1702-1707. doi: 10.1016/j.pain.2014.05.006. Epub May 10, 2014.
Dianov et al., Mammalian base excision repair: the forgotten archangel. Nucleic Acids Res. Apr. 1, 2013;41(6):3483-90. doi: 10.1093/nar/gkt076. Epub Feb. 13, 2013.
DiCarlo et al., Genome engineering in *Saccharomyces cerevisiae* using CRISPR-Cas systems. Nucleic Acids Research Apr. 2013;41(7):4336-43.
DiCarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
DiCarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.
Dickey et al., Single-stranded DNA-binding proteins: multiple domains for multiple functions. Structure. Jul. 2, 2013;21(7):1074-84. doi: 10.1016/j.str.2013.05.013.
Dickinson et al., Experimental interrogation of the path dependence and stochasticity of protein evolution using phage-assisted continuous evolution. Proc Natl Acad Sci USA. May 2013;110(22):9007-12.
Dillon, Regulating gene expression in gene therapy. Trends Biotechnol. May 1993;11(5):167-73. doi: 10.1016/0167-7799(93)90109-M.
Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.
Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Dingwall et al., Nuclear targeting sequences—a consensus? Trends Biochem Sci. Dec. 1991;16(12):478-81. doi: 10.1016/0968-0004(91)90184-w.
Diver et al., Single-Step Synthesis of Cell-Permeable Protein Dimerizers That Activate Signal Transduction and Gene Expression. J. Am. Chem. Soc. Jun. 4, 1997;119(22):5106-5109. https://doi.org/10.1021/ja963891c.
Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.
Doench et al., Optimized sgRNA design to maximize activity and minimize off-target effects of CRISPR-Cas9. Nat Biotechnol. Feb. 2016;34(2):184-191. doi: 10.1038/nbt.3437.
Doench et al., Rational design of highly active sgRNAs for CRISPR-Cas9-mediated gene inactivation. Nat Biotechnol. Dec. 2014;32(12):1262-7. doi: 10.1038/nbt.3026. Epub Sep. 3, 2014.
Dolan et al., Trans-splicing with the group I intron ribozyme from Azoarcus. RNA. Feb. 2014;20(2):202-13. doi: 10.1261/rna.041012.113. Epub Dec. 16, 2013.
Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.
Dominissini et al., Topology of the human and mouse m6A RNA methylomes revealed by m6A-seq. Nature. Apr. 29, 2012;485(7397):201-6. doi: 10.1038/nature11112.
Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.
Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.
Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.
Doudna et al., Genome editing. The new frontier of genome engineering with CRISPR-Cas9. Science. Nov. 28, 2014;346(6213):1258096. doi: 10.1126/science.1258096.
Doudna, The promise and challenge of therapeutic genome editing. Nature. Feb. 2020;578(7794):229-236. doi: 10.1038/s41586-020-1978-5. Epub Feb. 12, 2020.
Dove et al., Conversion of the omega subunit of *Escherichia coli* RNA polymerase into a transcriptional activator or an activation target. Genes Dev. Mar. 1, 1998;12(5):745-54.
Doyon et al., Directed evolution and substrate specificity profile of homing endonuclease I-SceI. J Am Chem Soc. Feb. 22, 2006;128(7):2477-84.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Drake, A constant rate of spontaneous mutation in DNA-based microbes. Proc Natl Acad Sci USA. Aug. 15, 1991;88(16):7160-4.
Dubois et al., Retroviral RNA Dimerization: From Structure to Functions. Front Microbiol. Mar. 22, 2018;9:527. doi: 10.3389/fmicb.2018.00527.
Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
Dunbar et al., Gene therapy comes of age. Science. Jan. 12, 2018;359(6372):eaan4672. doi: 10.1126/science.aan4672.
Dupuy et al., Le syndrome de De La Chapelle [De La Chapelle syndrome]. Presse Med. Mar. 3, 2001;30(8):369-72. French.
Durai et al., A bacterial one-hybrid selection system for interrogating zinc finger-DNA interactions. Comb Chem High Throughput Screen. May 2006;9(4):301-11.
Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.
During et al., Controlled release of dopamine from a polymeric brain implant: in vivo characterization. Ann Neurol. Apr. 1989;25(4):351-6.
East-Seletsky et al., Two distinct RNase activities of CRISPR-C2c2 enable guide-RNA processing and RNA detection. Nature Oct. 2016;538(7624):270-3.
Edlund et al., Cell-specific expression of the rat insulin gene: evidence for role of two distinct 5' flanking elements. Science. Nov. 22, 1985;230(4728):912-6. doi: 10.1126/science.3904002.
Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.
Edwards et al., Crystal structures of the thi-box riboswitch bound to thiamine pyrophosphate analogs reveal adaptive RNA-small molecule recognition. Structure. Sep. 2006;14(9):1459-68.
Eick et al., Robustness of Reconstructed Ancestral Protein Functions to Statistical Uncertainty. Mol Biol Evol. Feb. 1, 2017;34(2):247-261. doi: 10.1093/molbev/msw223.
Eiler et al., Structural Basis for the Fast Self-Cleavage Reaction Catalyzed by the Twister Ribozyme. Proc Natl Acad Sci U S A. Sep. 9, 2014;111(36):13028-33. doi: 10.1073/pnas.1414571111. Epub Aug. 25, 2014.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.
Emery et al., HCN2 ion channels play a central role in inflammatory and neuropathic pain. Science. Sep. 9, 2011;333(6048):1462-6. doi: 10.1126/science.1206243.

(56) References Cited

OTHER PUBLICATIONS

Endo et al., Toward establishing an efficient and versatile gene targeting system in higher plants. Biocatalysis and Agricultural Biotechnology 2014;3,(1):2-6.

Engel et al., The emerging role of mRNA methylation in normal and pathological behavior. Genes Brain Behav. Mar. 2018;17(3):e12428. doi: 10.1111/gbb.12428. Epub Nov. 17, 2017.

Engelward et al., Base excision repair deficient mice lacking the Aag alkyladenine DNA glycosylase. Proc Natl Acad Sci U S A. Nov. 25, 1997;94(24):13087-92.

England, Unnatural amino acid mutagenesis: a precise tool for probing protein structure and function. Biochemistry. Sep. 21, 2004;43(37):11623-9.

Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.

Epstein, HSV-1-based amplicon vectors: design and applications. Gene Ther. Oct. 2005;12 Suppl 1:S154-8. doi: 10.1038/sj.gt.3302617.

Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.

Esvelt et al., A system for the continuous directed evolution of biomolecules. Nature. Apr. 28, 2011;472(7344):499-503. doi: 10.1038/nature09929. Epub Apr. 10, 2011.

Esvelt et al., Genome-scale engineering for systems and synthetic biology. Mol Syst Biol. 2013;9:641. doi: 10.1038/msb.2012.66.

Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.

Evans et al., Protein trans-splicing and cyclization by a naturally split intein from the dnaE gene of *Synechocystis* species PCC6803. J Biol Chem. Mar. 31, 2000;275(13):9091-4. doi: 10.1074/jbc.275.13.9091.

Evans et al., Semisynthesis of cytotoxic proteins using a modified protein splicing element. Protein Sci. Nov. 1998;7(11):2256-64. doi: 10.1002/pro.5560071103.

Evans et al., The cyclization and polymerization of bacterially expressed proteins using modified self-splicing inteins. J Biol Chem. Jun. 25, 1999;274(26):18359-63. doi: 10.1074/jbc.274.26.18359.

Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.

Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.

Fagerlund et al., The Cpf1 CRISPR-Cas protein expands genome-editing tools. Genome Biology Nov. 17, 2015;16:251. https://doi.org/10.1186/s13059-015-0824-9.

Falnes et al., DNA repair by bacterial AlkB proteins. Res Microbiol. Oct. 2003;154(8):531-8. doi: 10.1016/S0923-2508(03)00150-5.

Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.

Fang et al., Synthetic Studies Towards Halichondrins: Synthesis of the Left Halves of Norhalichondrins and Homohalichondrins. Tetrahedron Letters 1992;33(12):1557-1560.

Farboud et al., Dramatic enhancement of genome editing by CRISPR/Cas9 through improved guide RNA design. Genetics. Apr. 2015;199(4):959-71. doi: 10.1534/genetics.115.175166. Epub Feb. 18, 2015.

Farhood et al., Codelivery to mammalian cells of a transcriptional factor with cis-acting element using cationic liposomes. Anal Biochem. Feb. 10, 1995;225(1):89-93.

Fawcett et al., Transposable elements controlling I-R hybrid dysgenesis in *D. melanogaster* are similar to mammalian LINEs. Cell. Dec. 26, 1986;47(6):1007-15. doi: 10.1016/0092-8674(86)90815-9.

Feldstein et al., Two sequences participating in the autolytic processing of satellite tobacco ringspot virus complementary RNA. Gene. Oct. 15, 1989;82(1):53-61. doi: 10.1016/0378-1119(89)90029-2.

Felletti et al., Twister Ribozymes as Highly Versatile Expression Platforms for Artificial Riboswitches. Nat Commun. Sep. 27, 2016;7:12834. doi: 10.1038/ncomms12834.

Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.

Feng et al., Human L1 retrotransposon encodes a conserved endonuclease required for retrotransposition. Cell. Nov. 29, 1996;87(5):905-16. doi: 10.1016/s0092-8674(00)81997-2.

Ferretti et al., Complete genome sequence of an M1 strain of *Streptococcus pyogenes*. Proc Natl Acad Sci U S A. Apr. 10, 2001;98(8):4658-63.

Ferry et al., Rational design of inducible CRISPR guide RNAs for de novo assembly of transcriptional programs. Nat Commun. Mar. 3, 2017;8:14633. doi: 10.1038/ncomms14633.

Feuk, Inversion variants in the human genome: role in disease and genome architecture. Genome Med. Feb. 12, 2010;2(2):11. doi: 10.1186/gm132.

Filippov et al., A novel type of RNase III family proteins in eukaryotes. Gene. Mar. 7, 2000;245(1):213-21. doi: 10.1016/s0378-1119(99)00571-5.

Fine et al., Trans-spliced Cas9 allows cleavage of HBB and CCR5 genes in human cells using compact expression cassettes. Scientific Reports 2015;5(1):Article No. 10777. doi: 10.1038/srep10777. With Supplementary Information.

Fire et al., Potent and specific genetic interference by double-stranded RNA in Caenorhabditis elegans. Nature. Feb. 19, 1998;391(6669):806-11. doi: 10.1038/35888.

Fischbach et al., Directed evolution can rapidly improve the activity of chimeric assembly-line enzymes. Proc Natl Acad Sci U S A. Jul. 17, 2007;104(29):11951-6. doi: 10.1073/pnas.0705348104. Epub Jul. 9, 2007.

Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.

Fitzjohn, Diversitree: comparative phylogenetic analyses of diversification in R. Methods in Evology and Evolution. Dec. 2012;3(6):1084-92 .doi: 10.1111/j.2041-210X.2012.00234.x.

Flajolet et al., Woodchuck hepatitis virus enhancer I and enhancer II are both involved in—myc2 activation in woodchuck liver tumors. J Virol. Jul. 1998;72(7):6175-80. doi: 10.1128/JVI.72.7.6175-6180.1998.

Flaman et al., A rapid PCR fidelity assay. Nucleic Acids Res. Aug. 11, 1994;22(15):3259-60. doi: 10.1093/nar/22.15.3259.

Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 19, 2015. Including supplementary figures and data.

Fogg et al., New applications for phage integrases. J Mol Biol. Jul. 29, 2014;426(15):2703-16. doi: 10.1016/j.jmb.2014.05.014. Epub May 22, 2014.

Fogg et al., Genome Integration and Excision by a New Streptomyces Bacteriophage, ?Joe. Appl Environ Microbiol. Feb. 15, 2017;83(5):e02767-16. doi: 10.1128/AEM.02767-16.

Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.

Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013. Including Supplementary Information.

(56) References Cited

OTHER PUBLICATIONS

Forster et al., Self-cleavage of virusoid RNA is performed by the proposed 55-nucleotide active site. Cell. Jul. 3, 1987;50(1):9-16. doi: 10.1016/0092-8674(87)90657-x.
Fortini et al., Different DNA polymerases are involved in the short- and long-patch base excision repair in mammalian cells. Biochemistry. Mar. 17, 1998;37(11):3575-80. doi: 10.1021/bi972999h.
Fouts et al., Sequencing Bacillus anthracis typing phages gamma and cherry reveals a common ancestry. J Bacteriol. May 2006;188(9):3402-8. doi: 10.1128/JB.188.9.3402-3408.2006.
Freitas et al., Mechanisms and signals for the nuclear import of proteins. Curr Genomics. Dec. 2009;10(8):550-7. doi: 10.2174/138920209789503941.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fu et al., Promises and Pitfalls of Intracellular Delivery of Proteins. Bioconjugate Chemistry. Aug. 2014;25:1602-8.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fukui et al., DNA Mismatch Repair in Eukaryotes and Bacteria. J Nucleic Acids. Jul. 27, 2010;2010. pii: 260512. doi: 10.4061/2010/260512.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Furukawa et al., In vitro selection of allosteric ribozymes that sense the bacterial second messenger c-di-GMP. Methods Mol Biol. 2014;1111:209-20. doi: 10.1007/978-1-62703-755-6_15.
Fusi et al., In Silico Predictive Modeling of CRISPR/Cas9 guide efficiency. Jun. 26, 2015; bioRxiv. http://dx.doi.org/10.1101/021568.
Gaj et al., 3rd. Genome engineering with custom recombinases. Methods Enzymol. 2014;546:79-91. doi: 10.1016/B978-0-12-801185-0.00004-0.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., Structure-guided reprogramming of serine recombinase DNA sequence specificity. Proc Natl Acad Sci U S A. Jan. 11, 2011;108(2):498-503. doi: 10.1073/pnas.1014214108. Epub Dec. 27, 2010.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gajula, Designing an Elusive CoG?GoC CRISPR Base Editor. Trends Biochem Sci. Feb. 2019;44(2):91-94. doi: 10.1016/j.tibs.2018.10.004. Epub Nov. 13, 2018.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gangopadhyay et al., Precision Control of CRISPR-Cas9 Using Small Molecules and Light. Biochemistry. Jan. 29, 2019;58(4):234-244. doi: 10.1021/acs.biochem.8b01202. Epub Jan. 22, 2019.

Gao et al., Cationic liposome-mediated gene transfer. Gene Ther. Dec. 1995;2(10):710-22.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gao et al., Prime editing in mice reveals the essentiality of a single base in driving tissue-specific gene expression. Genome Biol. Mar. 16, 2021;22(1):83. doi: 10.1186/s13059-021-02304- 3.
Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.
Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.
Gapinske et al., CRISPR-SKIP: programmable gene splicing with single base editors. Genome Biol. Aug. 15, 2018;19(1):107. doi: 10.1186/s13059-018-1482-5.
Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.
Gardlik et al., Vectors and delivery systems in gene therapy. Med Sci Monit. Apr. 2005;11(4):RA110-21. Epub Mar. 24, 2005.
Garibyan et al., Use of the rpoB gene to determine the specificity of base substitution mutations on the *Escherichia coli* chromosome. DNA Repair (Amst). May 13, 2003;2(5):593-608.
Garneau et al., The CRISPR/Cas bacterial immune system cleaves bacteriophage and plasmid DNA. Nature. Nov. 4, 2010;468(7320):67-71. doi: 10.1038/nature09523.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Gaudelli et al., Programmable base editing of AoT to GoC in genomic DNA without DNA cleavage. Nature. Nov. 23, 2017;551(7681):464-471. doi: 10.1038/nature24644. Epub Oct. 25, 2017. Erratum in: Nature. May 2, 2018.
Gearing, Addgene blog. CRISPR 101: Cas9 nickase design and homology directed repair. 2018. pp. 1-12. https://blog.addgene.org/crispr-101-cas9-nickase-design-and-homlogy-directed-repair. Last retrieved online Jun. 25, 2021.
Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.
GenBank Accession No. J01600.1. Brooks et al., *E.coli* dam gene coding for DNA adenine methylase. Apr. 26, 1993.
GenBank Accession No. U07651.1. Lu, *Escherichia coli* K12 negative regulator of replication initiation (seqA) gene, complete cds. Jul. 19, 1994.
GenBank Submission; NIH/NCBI Accession No. 4UN5_B. Anders et al., Jul. 23, 2014. 5 pages.
GenBank Submission; NIH/NCBI Accession No. NM_001319224. 2. Umar et al., Apr. 21, 2021. 7 pages.
GenBank Submission; NIH/NCBI Accession No. NM_006027.4. Umar et al., Apr. 10, 2021. 7 pages.
GenBank Submission; NIH/NCBI, Accession No. AAA66622.1. Martinelli et al., May 18, 1995. 2 pages.
GenBank Submission; NIH/NCBI, Accession No. AGT42196. Farzadfar et al., Nov. 2, 2013. 2 pages.
GenBank Submission; NIH/NCBI, Accession No. AIT42264.1. Hyun et al., Oct. 15, 2014. 2 pages.
GenBank Submission; NIH/NCBI, Accession No. AKA60242.1. Tong et al., Apr. 5, 2015. 1 page.
GenBank Submission; NIH/NCBI, Accession No. AKQ21048.1. Gilles et al., Jul. 19, 2015. 1 page.
GenBank Submission; NIH/NCBI, Accession No. AKS40380.1. Nodvig et al., Aug. 2, 2015. 1 page.
GenBank Submission; NIH/NCBI, Accession No. APG80656.1. Burstein et al., Dec. 10, 2016. 1 pages.

(56) References Cited

OTHER PUBLICATIONS

GenBank Submission; NIH/NCBI, Accession No. AYD60528.1. Ram et al., Oct. 2, 2018. 1 page.
GenBank Submission; NIH/NCBI, Accession No. BDB43378. Zhang et al., Aug. 11, 2016. 2 pages.
GenBank Submission; NIH/NCBI, Accession No. J04623. Kita et al., Apr. 26, 1993. 2 pages.
GenBank Submission; NIH/NCBI, Accession No. KR710351.1. Sahni et al., Jun. 1, 2015. 2 pages.
GenBank Submission; NIH/NCBI, Accession No. NC 002737.2. Nasser et al., Feb. 7, 2021. 2 pages.
GenBank Submission; NIH/NCBI, Accession No. NC_002737.1. Ferretti et al., Jun. 27, 2013. 1 page.
GenBank Submission; NIH/NCBI, Accession No. NC_015683.1. Trost et al., Jul. 6, 2013. 1 page.
GenBank Submission; NIH/NCBI, Accession No. NC_016782.1. Trost et al., Jun. 11, 2013. 1 page.
GenBank Submission; NIH/NCBI, Accession No. NC_016786.1. Trost et al., Aug. 28, 2013. 1 page.
GenBank Submission; NIH/NCBI, Accession No. NC_017053.1. Fittipaldi et al., Jul. 6, 2013. 1 page.
GenBank Submission; NIH/NCBI, Accession No. NC_017317.1. Trost et al., Jun. 11, 2013. 1 page.
GenBank Submission; NIH/NCBI, Accession No. NC_017861.1. Heidelberg et al., Jun. 11, 2013. 1 page.
GenBank Submission; NIH/NCBI, Accession No. NC_018010.1. Lucas et al., Jun. 11, 2013. 2 pages.
GenBank Submission; NIH/NCBI, Accession No. NC_018721.1. Feng et al., Jun. 11, 2013. 1 pages.
GenBank Submission; NIH/NCBI, Accession No. NC_021284.1. Ku et al., Jul. 12, 2013. 1 page.
GenBank Submission; NIH/NCBI, Accession No. NC_021314.1. Zhang et al., Jul. 15, 2013. 1 page.
GenBank Submission; NIH/NCBI, Accession No. NC_021846.1. Lo et al., Jul. 22, 2013. 1 page.
GenBank Submission; NIH/NCBI, Accession No. NM_000311.5. Alves et al., Mar. 7, 2021. 5 pages.
GenBank Submission; NIH/NCBI, Accession No. NM_001319224. Umar et al., Apr. 21, 2021. 7 pages.
GenBank Submission; NIH/NCBI, Accession No. NM_002945.3. Weiser et al., Sep. 3, 2017. 5 pages.
GenBank Submission; NIH/NCBI, Accession No. NM_002946.5. Kavli et al., Jun. 26, 2021. 5 pages.
GenBank Submission; NIH/NCBI, Accession No. NM_002947.4. Xiao et al., May 1, 2019. 4 pages.
GenBank Submission; NIH/NCBI, Accession No. NM_003686. Umar et al., Apr. 9, 2021. 7 pages.
GenBank Submission; NIH/NCBI, Accession No. NM_003686.4. Umar et al., Apr. 9, 2021. 7 pages.
GenBank Submission; NIH/NCBI, Accession No. NM_006027. Umar et al., Apr. 10, 2021. 7 pages.
GenBank Submission; NIH/NCBI, Accession No. NM_174936. Guo et al., Oct. 28, 2015. 6 pages.
GenBank Submission; NIH/NCBI, Accession No. NP_000302.1. Alves et al., Mar. 7, 2021. 4 pages.
GenBank Submission; NIH/NCBI, Accession No. NP_001243439.1. Lee et al., Jul. 26, 2021. 4 pages.
GenBank Submission; NIH/NCBI, Accession No. NP_076161.2. Wade et al., Jun. 20, 2021. 4 pages.
GenBank Submission; NIH/NCBI, Accession No. NP_358988.1. Hoskins et al., Jan. 11, 2017. 2 pages.
GenBank Submission; NIH/NCBI, Accession No. NP_391970.1. Borriss et al., Feb. 12, 2021. 3 pages.
GenBank Submission; NIH/NCBI, Accession No. NP_472073.1. Glaser et al., Jun. 27, 2013. 2 pages.
GenBank Submission; NIH/NCBI, Accession No. NP_628093.1. Hsiao et al., Aug. 3, 2016. 2 pages.
GenBank Submission; NIH/NCBI, Accession No. NP_955579.1. Chen et al., Aug. 13, 2018. 5 pages.
GenBank Submission; NIH/NCBI, Accession No. P42212. Prasher et al., Mar. 19, 2014. 7 pages.
GenBank Submission; NIH/NCBI, Accession No. QBJ66766. Duan et al. Aug. 12, 2020. 2 pages.
GenBank Submission; NIH/NCBI, Accession No. RFF81513.1. Zhou et al., Aug. 21, 2018. 2 pages.
GenBank Submission; NIH/NCBI, Accession No. SNX31424.1. Weckx, S., Feb. 16, 2018. 2 pages.
GenBank Submission; NIH/NCBI, Accession No. TGH57013. Xu et al., Apr. 9, 2019. 2 pages.
GenBank Submission; NIH/NCBI, Accession No. WP_002989955.1. No Author Listed, May 6, 2013. 1 page.
GenBank Submission; NIH/NCBI, Accession No. WP_010922251.1. No Author Listed, May 15, 2013. 1 page.
GenBank Submission; NIH/NCBI, Accession No. WP_011054416.1. No Author Listed, May 15, 2013. 1 page.
GenBank Submission; NIH/NCBI, Accession No. WP_011284745.1. No Author Listed, May 16, 2013. 1 page.
GenBank Submission; NIH/NCBI, Accession No. WP_011285506.1. No Author Listed, May 16, 2013. 1 page.
GenBank Submission; NIH/NCBI, Accession No. WP_011527619.1. No Author Listed, May 16, 2013. 1 page.
GenBank Submission; NIH/NCBI, Accession No. WP_012560673.1. No Author Listed, May 17, 2013. 1 page.
GenBank Submission; NIH/NCBI, Accession No. WP_014407541.1. No Author Listed, May 18, 2013. 1 page.
GenBank Submission; NIH/NCBI, Accession No. WP_016631044.1. Haft et al., Sep. 22, 2020. 1 page.
GenBank Submission; NIH/NCBI, Accession No. WP_020905136.1. No Author Listed, Jul. 25, 2013. 1 page.
GenBank Submission; NIH/NCBI, Accession No. WP_023080005.1. No Author Listed, Oct. 27, 2013. 1 page.
GenBank Submission; NIH/NCBI, Accession No. WP_023610282.1. No Author Listed, Nov. 27, 2013. 1 page.
GenBank Submission; NIH/NCBI, Accession No. WP_030125963.1. No Author Listed, Jul. 9, 2014. 1 page.
GenBank Submission; NIH/NCBI, Accession No. WP_030126706.1. No Author Listed, Jul. 9, 2014. 1 page.
GenBank Submission; NIH/NCBI, Accession No. WP_031386437.1. No Author Listed., Sep. 23, 2019. 1 page.
GenBank Submission; NIH/NCBI, Accession No. WP_031488318.1. No Author Listed., Aug. 5, 2014. 1 page.
GenBank Submission; NIH/NCBI, Accession No. WP_031589969.1. Haft et al., Oct. 9, 2019. 2 pages.
GenBank Submission; NIH/NCBI, Accession No. WP_032460140.1. No Author Listed, Oct. 4, 2014. 1 page.
GenBank Submission; NIH/NCBI, Accession No. WP_032461047.1. No Author Listed, Oct. 4, 2014. 1 page.
GenBank Submission; NIH/NCBI, Accession No. WP_032462016.1. Haft et al., Oct. 4, 2014. 1 page.
GenBank Submission; NIH/NCBI, Accession No. WP_032462936.1. No Author Listed, Oct. 4, 2014. 1 page.
GenBank Submission; NIH/NCBI, Accession No. WP_032464890.1. No Author Listed, Oct. 4, 2014. 1 page.
GenBank Submission; NIH/NCBI, Accession No. WP_038431314.1. No Author Listed, Dec. 26, 2014. 1 page.
GenBank Submission; NIH/NCBI, Accession No. WP_038432938.1. No Author Listed, Dec. 26, 2014. 1 page.
GenBank Submission; NIH/NCBI, Accession No. WP_038434062.1. No Author Listed, Dec. 26, 2014. 1 page.
GenBank Submission; NIH/NCBI, Accession No. WP_044924278.1. Haft et al., Oct. 9, 2019. 2 pages.
GenBank Submission; NIH/NCBI, Accession No. WP_047338501.1. Haft et al., Oct. 9, 2019. 2 pages.
GenBank Submission; NIH/NCBI, Accession No. WP_048327215.1. No Author Listed, Jun. 26, 2015. 1 page.
GenBank Submission; NIH/NCBI, Accession No. WP_049519324.1. No Author Listed, Jul. 20, 2015. 1 page.
GenBank Submission; NIH/NCBI, Accession No. WP_060798984.1. Haft et al., Oct. 9, 2019. 2 pages.
GenBank Submission; NIH/NCBI, Accession No. WP_062913273.1. Haft et al., Oct. 9, 2019, 2 pages.

(56) References Cited

OTHER PUBLICATIONS

GenBank Submission; NIH/NCBI, Accession No. WP_072754838. No Author Listed., Sep. 23, 2019. 1 page.
GenBank Submission; NIH/NCBI, Accession No. WP_095142515. 1. No Author Listed., Sep. 23, 2019. 1 page.
GenBank Submission; NIH/NCBI, Accession No. WP_118538418. 1. No Author Listed., Oct. 13, 2019. 1 page.
GenBank Submission; NIH/NCBI, Accession No. WP_119223642. 1. No Author Listed., Oct. 13, 2019. 1 page.
GenBank Submission; NIH/NCBI, Accession No. WP_119227726. 1. No Author Listed., Oct. 13, 2019. 1 page.
GenBank Submission; NIH/NCBI, Accession No. WP_119623382. 1. No Author Listed., Oct. 13, 2019. 1 page.
GenBank Submission; NIH/NCBI, Accession No. WP_132221894. 1. No Author Listed., Sep. 23, 2019. 1 page.
GenBank Submission; NIH/NCBI, Accession No. WP_133478044. 1. Haft et al., Oct. 9, 2019. 2 pages.
GenBank Submission; NIH/NCBI, Accession No. YP_002004532. 1. Villegas et al., Oct. 11, 2021. 2 pages.
GenBank Submission; NIH/NCBI, Accession No. YP_002342100. 1. Bernardini et al., Jun. 10, 2013. 2 pages.
GenBank Submission; NIH/NCBI, Accession No. YP_002344900. 1. Gundogdu et al., Mar. 19, 2014. 2 pages.
GenBank Submission; NIH/NCBI, Accession No. YP_006589943. 1. Lynch et al., Oct. 15, 2021. 2 pages.
GenBank Submission; NIH/NCBI, Accession No. YP_009137104. 1. Davison, Aug. 13, 2018. 2 pages.
GenBank Submission; NIH/NCBI, Accession No. YP_009283008. 1. Bernardini et al., Sep. 23, 2016. 2 pages.
GenBank Submission; NIH/NCBI, Accession No. YP_820832.1. Makarova et al., Aug. 27, 2013. 2 pages.
George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.
Gerard et al., Purification and characterization of the DNA polymerase and RNase H activities in Moloney murine sarcomaleukemia virus. J Virol. Apr. 1975;15(4):785-97. doi: 10.1128/JVI. 15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., An adenosine deaminase that generates inosine at the wobble position of tRNAs. Science. Nov. 5, 1999;286(5442):1146-9. doi: 10.1126/science.286.5442.1146.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gete et al., Mechanisms of angiogenic incompetence in Hutchinson-Gilford progeria via downregulation of endothelial NOS. Aging Cell. Jul. 2021;20(7):e13388. doi: 10.1111/acel.13388. Epub Jun. 4, 2021.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1):15432. doi: 10.1038/s41598-017-15648-3.
Gibson et al., Enzymatic assembly of DNA molecules up to several hundred kilobases. Nat Methods. May 2009;6(5):343-5. doi: 10.1038/nmeth.1318. Epub Apr. 12, 2009.
Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Glasgow et al.,DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.
Goldberg et al., Epigenetics: a landscape takes shape. Cell. Feb. 23, 2007;128(4):635-8. doi: 10.1016/j.cell.2007.02.006.
Goldberg et al., Loss-of-function mutations in the Nav1.7 gene underlie congenital indifference to pain in multiple human populations. Clin Genet. Apr. 2007;71(4):311-9. doi: 10.1111/j.1399-0004. 2007.00790.x.
Gong et al., Active DNA demethylation by oxidation and repair. Cell Res. Dec. 2011;21(12):1649-51. doi: 10.1038/cr.2011.140. Epub Aug. 23, 2011.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014. 05.018. Epub Jun. 12, 2014.
Goodnough et al., Development of a delivery vehicle for intracellular transport of botulinum neurotoxin antagonists. FEBS Lett. Feb. 27, 2002;513(2-3):163-8.
Gordley et al., Evolution of programmable zinc finger-recombinases with activity in human cells. J Mol Biol. Mar. 30, 2007;367(3):802-13. Epub Jan. 12, 2007.
Gordley et al., Synthesis of programmable integrases. Proc Natl Acad Sci U S A. Mar. 31, 2009;106(13):5053-8. doi: 10.1073/pnas.0812502106. Epub Mar. 12, 2009.
Gou et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Grainge et al., The integrase family of recombinase: organization and function of the active site. Mol Microbiol. Aug. 1999;33(3):449-56.
Gregory et al., Integration site for Streptomyces phage phiBT1 and development of site-specific integrating vectors. J Bacteriol. Sep. 2003;185(17):5320-3. doi: 10.1128/jb.185.17.5320-5323.2003.
Griffiths, Endogenous retroviruses in the human genome sequence. Genome Biol. 2001;2(6):Reviews1017. doi: 10.1186/gb-2001-2-6-reviews1017. Epub Jun. 5, 2001.
Grindley et al., Mechanisms of site-specific recombination. Annu Rev Biochem. 2006;75:567-605. doi: 10.1146/annurev.biochem.73.011303.073908.
Grishok et al., Genes and Mechanisms Related to RNA Interference Regulate Expression of the Small Temporal RNAs that Control C. elegans Developmental Timing. Jul. 13, 2001:106(1):P23-4.
Groher et al., Synthetic riboswitches—A tool comes of age. Biochim Biophys Acta. Oct. 2014;1839(10):964-973. doi: 10.1016/j.bbagrm.2014.05.005. Epub May 17, 2014.
Groth et al., Construction of transgenic *Drosophila* by using the site-specific integrase from phage phiC31. Genetics. Apr. 2004;166(4):1775-82. doi: 10.1534/genetics.166.4.1775.
Groth et al., Phage integrases: biology and applications. J Mol Biol. Jan. 16, 2004;335(3):667-78.
Gruber et al., Strategies for measuring evolutionary conservation of RNA secondary structures. BMC Bioinformatics. Feb. 26, 2008;9:122. doi: 10.1186/1471-2105-9-122.
Gruber et al., The Vienna RNA websuite. Nucleic Acids Res. Jul. 1, 2008;36(Web Server issue): W70-4. doi: 10.1093/nar/gkn188. Epub Apr. 19, 2008.
Grunebaum et al., Recent advances in understanding and managing adenosine deaminase and purine nucleoside phosphorylase deficiencies.

(56) References Cited

OTHER PUBLICATIONS

Curr Opin Allergy Clin Immunol. Dec. 2013;13(6):630-8. doi: 10.1097/ACI.0000000000000006.

Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.

Guedon et al., Current gene therapy using viral vectors for chronic pain. Mol Pain. May 13, 2015;11:27. doi: 10.1186/s12990-015-0018-1.

Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.

Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.

Gumulya et al., Exploring the past and the future of protein evolution with ancestral sequence reconstruction: the 'retro' approach to protein engineering. Biochem J. Jan. 1, 2017;474(1):1-19. doi: 10.1042/BCJ20160507.

Guo et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.

Guo et al., Evolution of Tetrahymena ribozyme mutants with increased structural stability. Nat Struct Biol. Nov. 2002;9(11):855-61. doi: 10.1038/nsb850.

Guo et al., Facile functionalization of FK506 for biological studies by the thiol-ene 'click' reaction. RSC Advances. 2014;22:11400-3.

Guo et al., Protein tolerance to random amino acid change. Proc Natl Acad Sci U S A. Jun. 22, 2004;101(25):9205-10. Epub Jun. 14, 2004.

Guo et al., Structure of Cre recombinase complexed with DNA in a site-specific recombination synapse. Nature. Sep. 4, 1997;389(6646):40-6.

Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.

Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.

Guzman et al., Tight regulation, modulation, and high-level expression by vectors containing the arabinose PBAD promoter. J Bacteriol. 1995;177(14):4121-4130.

Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.

Haddada et al., Gene therapy using adenovirus vectors. Curr Top Microbiol Immunol. 1995;199 ( Pt 3):297-306. doi: 10.1007/978-3-642-79586-2_14.

Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.

Hale et al., RNA-guided RNA cleavage by a CRISPR RNA-Cas protein complex. Cell. Nov. 25, 2009;139(5):945-56. doi: 10.1016/j.cell.2009.07.040.

Halmai et al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confex.com/aiche/epibiol8/webprogram/paper544785.html. Retrieved Jun. 29, 2020.

Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.

Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.

Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.

Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.

Handa et al., Template-assisted synthesis of adenine-mutagenized cDNA by a retroelement protein complex. Nucleic Acids Res. Oct. 12, 2018;46(18):9711-9725. doi: 10.1093/nar/gky620.

Hanna et al., Massively parallel assessment of human variants with base editor screens. Cell. Feb. 18, 2021;184(4):1064-1080.e20. doi: 10.1016/j.cell.2021.01.012.

Hanson et al., Codon optimality, bias and usage in translation and mRNA decay. Nat Rev Mol Cell Biol. Jan. 2018;19(1):20-30. doi: 10.1038/nrm.2017.91. Epub Oct. 11, 2017.

Harms et al., Evolutionary biochemistry: revealing the historical and physical causes of protein properties. Nat Rev Genet. Aug. 2013;14(8):559-71. doi: 10.1038/nrg3540.

Harrington et al., A thermostable Cas9 with increased lifetime in human plasma. Nat Commun. Nov. 10, 2017;8(1):1424. doi: 10.1038/s41467-017-01408-4. Posted May 16, 2017 as bioRxiv preprint. Doi.org/10.1101/138867.

Harris et al., RNA Editing Enzyme APOBEC1 and Some of Its Homologs Can Act as DNA Mutators. Mol Cell. Nov. 2002;10(5):1247-53.

Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.

Hartung et al., Cre mutants with altered DNA binding properties. J Biol Chem. Sep. 4, 1998;273(36):22884-91.

Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.

Hasegawa et al., Spontaneous mutagenesis associated with nucleotide excision repair in *Escherichia coli*. Genes Cells. May 2008;13(5):459-69. doi: 10.1111/j.1365-2443.2008.01185.x.

Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.

Hector et al., CDKL5 variants: Improving our understanding of a rare neurologic disorder. Neurol Genet. Dec. 15, 2017;3(6):e200. doi: 10.1212/NXG.0000000000000200.

Heidenreich et al., Non-homologous end joining as an important mutagenic process in cell cycle-arrested cells. EMBO J. May 1, 2003;22(9):2274-83. doi: 10.1093/emboj/cdg203.

Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.

Heller et al., Replisome assembly and the direct restart of stalled replication forks. Nat Rev Mol Cell Biol. Dec. 2006;7(12):932-43. Epub Nov. 8, 2006.

Hendricks et al., The S. cerevisiae Mag1 3-methyladenine DNA glycosylase modulates susceptibility to homologous recombination. DNA Repair (Amst). 2002;1(8):645-659.

Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.

Herschhorn et al., Retroviral reverse transcriptases. Cell Mol Life Sci. Aug. 2010;67(16):2717-47. doi: 10.1007/s00018-010-0346-2. Epub Apr. 1, 2010.

(56) References Cited

OTHER PUBLICATIONS

Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.
Hida et al., Directed evolution for drug and nucleic acid; delivery. Adv Drug Deliv Rev. Dec. 22, 2007;59(15):1562-78. Epub Aug. 28, 2007.; Review.
Higgs et al., Genetic complexity in sickle cell disease. Proc Natl Acad Sci U S A. Aug. 19, 2008;105(33):11595-6. doi: 10.1073/pnas.0806633105. Epub Aug. 11, 2008.
Hill et al., Functional analysis of conserved histidines in ADP-glucose pyrophosphorylase from *Escherichia coli*.Biochem Biophys Res Commun. Mar. 17, 1998;244(2):573-7.
Hille et al., The Biology of CRISPR-Cas: Backward and Forward. Cell. Mar. 8, 2018;172(6):1239-1259. doi: 10.1016/j.cell.2017.11.032.
Hilton et al., Enabling functional genomics with genome engineering. Genome Res. Oct. 2015;25(10):1442-55. doi: 10.1101/gr.190124.115.
Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.
Hirano et al., Structural Basis for the Altered PAM Specificities of Engineered CRISPR-Cas9. Mol Cell. Mar. 17, 2016;61(6):886-94. doi: 10.1016/j.molcel.2016.02.018.
Hoang et al., UFBoot2: Improving the Ultrafast Bootstrap Approximation. Mol Biol Evol. Feb. 1, 2018;35(2):518-522. doi: 10.1093/molbev/msx281.
Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Hoernes et al., Translating the epitranscriptome. Wiley Interdiscip Rev RNA. Jan. 2017;8(1):e1375. doi: 10.1002/wrna.1375. Epub Jun. 27, 2016.
Hoess et al., DNA specificity of the Cre recombinase resides in the 25 kDa carboxyl domain of the protein. J Mol Biol. Dec. 20, 1990;216(4):873-82. doi: 10.1016/S0022-2836(99)80007-2.
Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.
Hollis et al., Phage integrases for the construction and manipulation of transgenic mammals. Reprod Biol Endocrinol. Nov. 7, 2003;1:79. doi: 10.1186/1477-7827-1-79.
Holsinger et al., Signal transduction in T lymphocytes using a conditional allele of Sos. Proc Natl Acad Sci U S A. Oct. 10, 1995;92(21):9810-4. doi: 10.1073/pnas.92.21.9810.
Holt et al., Human hematopoietic stem/progenitor cells modified by zinc-finger nucleases targeted to CCR5 control HIV-1 in vivo. Nat Biotechnol. Aug. 2010;28(8):839-47. doi: 10.1038/nbt.1663. Epub Jul. 2, 2010.
Hondares et al., Peroxisome Proliferator-activated Receptor ? (PPAR?) Induces PPAR? Coactivator 1? (PGC-1?) Gene Expression and Contributes to Thermogenic Activation of Brown Fat. J Biol. Chem Oct. 2011; 286(50):43112-22. doi: 10.1074/jbc.M111.252775.
Hoogenboom et al., Natural and designer binding sites made by phage display technology. Immunol Today. Aug. 2000;21(8):371-8.
Horvath et al., CRISPR/Cas, the immune system of bacteria and archaea. Science. Jan. 8, 2010;327(5962):167-70. doi: 10.1126/science.1179555.
Horvath et al., Diversity, Activity, and Evolution of CRISPR Loci in *Streptococcus thermophilus*. J Bacteriol. Feb. 2008;190(4):1401-12. doi: 10.1128/JB.01415-07. Epub Dec. 7, 2007.
Hotta et al., [Neurotropic viruses—classification, structure and characteristics]. Nihon Rinsho. Apr. 1997;55(4):777-82. Japanese.
Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.
Houdebine, The methods to generate transgenic animals and to control transgene expression. J Biotechnol. Sep. 25, 2002;98(2-3):145-60.
Housden et al., Identification of potential drug targets for tuberous sclerosis complex by synthetic screens combining CRISPR-based knockouts with RNAi. Sci Signal. Sep. 8, 2015;8(393):rs9. doi: 10.1126/scisignal.aab3729.
Howard et al., Intracerebral drug delivery in rats with lesion-induced memory deficits. J Neurosurg. Jul. 1989;71(1):105-12.
Hower et al., Shape-based peak identification for ChIP-Seq. BMC Bioinformatics. Jan. 12, 2011;12:15. doi: 10.1186/1471-2105-12-15.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013. Supplementary Information. 27 pages.
Hsu et al., PrimeDesign software for rapid and simplified design of prime editing guide RNAs. Nat Commun. Feb. 15, 2021;12(1):1034. doi: 10.1038/s41467-021-21337-7.
Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.
Hu et al., Evolved Cas9 variants with broad PAM compatibility and high DNA specificity. Nature. Apr. 5, 2018;556(7699):57-63 and Extended/Supplementary Data. doi: 10.1038/nature26155. Epub Feb. 28, 2018. 21 pages.
Hu et al., Evolved Cas9 variants with broad PAM compatibility and high DNA specificity. Nature. Apr. 5, 2018;556(7699):57-63. doi: 10.1038/nature26155. Epub Feb. 28, 2018.
Hua et al., Expanding the base editing scope in rice by using Cas9 variants. Plant Biotechnol J. Feb. 2019;17(2):499-504. doi: 10.1111/pbi.12993. Epub Oct. 5, 2018.
Hua et al., Precise A·T to G·C Base Editing in the Rice Genome. Mol Plant. Apr. 2, 2018;11(4):627-630. doi: 10.1016/j.molp.2018.02.007. Epub Feb. 21, 2018.
Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 2019. Including Supplementary Information.
Huang et al., Heritable gene targeting in zebrafish using customized TALENs. Nat Biotechnol. Aug. 5, 2011;29(8):699-700. doi: 10.1038/nbt.1939.
Huang et al., Precision genome editing using cytosine and adenine base editors in mammalian cells. Nat Protoc. Feb. 2021;16(2):1089-1128. doi: 10.1038/s41596-020-00450-9. Epub Jan. 18, 2021.
Huggins et al., Flap endonuclease 1 efficiently cleaves base excision repair and DNA replication intermediates assembled into nucleosomes. Mol Cell. Nov. 2002;10(5):1201-11. doi: 10.1016/s1097-2765(02)00736-0.
Humbert et al., Targeted gene therapies: tools, applications, optimization. Crit Rev Biochem Mol Biol. May-Jun. 2012;47(3):264-81. doi: 10.3109/10409238.2012.658112.
Hung et al., Protein localization in disease and therapy. J Cell Sci. Oct. 15, 2011;124(Pt 20):3381-92. doi: 10.1242/jcs.089110.
Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.

(56) References Cited

OTHER PUBLICATIONS

Husimi, Selection and evolution of bacteriophages in cellstat. Adv Biophys. ; 1989;25:1-43. Review.

Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.

Hwang et al., Efficient In Vivo Genome Editing Using RNA-Guided Nucleases. Nat Biotechnol. Mar. 2013; 31(3): 227-229. doi: 10.1038/nbt.2501. Epub Jan. 29, 2013.

Hwang et al., Web-based design and analysis tools for CRISPR base editing. BMC Bioinformatics. Dec. 27, 2018;19(1):542. doi: 10.1186/s12859-018-2585-4.

Ibba et al., Relaxing the substrate specificity of an aminoacyl-tRNA synthetase allows in vitro and in vivo synthesis of proteins containing unnatural amino acids. FEBS Lett. May 15, 1995;364(3):272-5.

Ibba et al., Substrate specificity is determined by amino acid binding pocket size in *Escherichia coli* phenylalanyl-tRNA synthetase. Biochemistry. Jun. 14, 1994;33(23):7107-12.

Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.

Iida et al., A site-specific, conservative recombination system carried by bacteriophage P1. Mapping the recombinase gene cin and the cross-over sites cix for the inversion of the C segment. EMBO J. 1982;1(11):1445-53.

Iida et al., The Min DNA inversion enzyme of plasmid p15B of *Escherichia coli* 15T-: a new member of the Din family of site-specific recombinases. Mol Microbiol. Jun. 1990;4(6):991-7. doi: 10.1111/j.1365-2958.1990.tb00671.x.

Ikediobi et al., Mutation analysis of 24 known cancer genes in the NCI-60 cell line set. Mol Cancer Ther. Nov. 2006;5(11):2606-12. Epub Nov. 6, 2006.

Imanishi et al., Detection of N6-methyladenosine based on the methyl-sensitivity of MazF RNA endonuclease. Chem Commun (Camb). Nov. 30, 2017;53(96):12930-12933. doi: 10.1039/c7cc07699a.

Imburgio et al., Studies of promoter recognition and start site selection by T7 RNA polymerase using a comprehensive collection of promoter variants. Biochemistry. Aug. 29, 2000;39(34):10419-30.

Ingram, A specific chemical difference between the globins of normal human and sickle-cell anaemia haemoglobin. Nature. Oct. 13, 1956;178(4537):792-4. doi: 10.1038/178792a0.

Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.

Irrthum et al., Congenital hereditary lymphedema caused by a mutation that inactivates VEGFR3 tyrosine kinase. Am J Hum Genet. Aug. 2000;67(2):295-301. Epub Jun. 9, 2000.

Ishino et al., Nucleotide sequence of the iap gene, responsible for alkaline phosphatase isozyme conversion in *Escherichia coli*, and identification of the gene product. J Bacteriol. Dec. 1987;169(12):5429-33.

Iwai et al., Circular beta-lactamase: stability enhancement by cyclizing the backbone. FEBS Lett. Oct. 8, 1999;459(2):166-72. doi: 10.1016/s0014-5793(99)01220-x.

Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.

Jaffrey et al., Emerging links between m6A and misregulated mRNA methylation in cancer. Genome Med. Jan. 12, 2017;9(1):2. doi: 10.1186/s13073-016-0395-8.

Jamieson et al., Drug discovery with engineered zinc-finger proteins. Nat Rev Drug Discov. May 2003;2(5):361-8.

Jansen et al., Backbone and nucleobase contacts to glucosamine-6-phosphate in the glmS ribozyme. Nat Struct Mol Biol. Jun. 2006;13(6):517-23. Epub May 14, 2006.

Jansen et al., Identification of genes that are associated with DNA repeats in prokaryotes. Mol Microbiol. Mar. 2002;43(6):1565-75.

Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.

Jasin et al., Repair of strand breaks by homologous recombination. Cold Spring Harb Perspect Biol. Nov. 1, 2013;5(11):a012740. doi: 10.1101/cshperspect.a012740.

Jeggo, DNA breakage and repair. Adv Genet. 1998;38:185-218. doi: 10.1016/s0065-2660(08)60144-3.

Jemielity et al., Novel "anti-reverse" cap analogs with superior translational properties. RNA. Sep. 2003;9(9):1108-22. doi: 10.1261/rna.5430403.

Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.

Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet.2012.08.013. Epub Aug. 23, 2012.

Jiang et al., Chemical modifications of adenine base editor mRNA and guide RNA expand its application scope. Nat Commun. Apr. 24, 2020;11(1): 1979. doi: 10.1038/s41467-020-15892-8.

Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.

Jiang et al., Prime editing efficiently generates W542L and S621I double mutations in two ALS genes of maize. bioRxiv preprint. Jul. 6, 2020. Retrieved from www.biorxiv.org. doi: 10.1101/2020.07.06.188896. 15 pages.

Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.

Jiang et al., Structural Biology. A Cas9-guide RNA Complex Preorganized for Target DNA Recognition. Science. Jun. 26, 2015;348(6242):1477-81. doi: 10.1126/science.aab1452.

Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.

Jin et al., Cytosine, but not adenine, base editors induce genome-wide off-target mutations in rice. Science. Apr. 19, 2019;364(6437):292-295. doi: 10.1126/science.aaw7166. Epub Feb. 28, 2019.

Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.

Jinek et al., RNA-programmed genome editing in human cells. Elife. Jan. 29, 2013;2:e00471. doi: 10.7554/eLife.00471.

Jinek et al., Structures of Cas9 endonucleases reveal RNA-mediated conformational activation. Science. Mar. 14, 2014;343(6176):1247997. doi: 10.1126/science.1247997. Epub Feb. 6, 2014.

Jiricny, The multifaceted mismatch-repair system. Nat Rev Mol Cell Biol. May 2006;7(5):335-46. doi: 10.1038/nrm1907.

Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.

Johansson et al., RNA Recognition by the MS2 Phage Coat Protein. Seminars in Virology. 1997;8(3):176-85. https://doi.org/10.1006/smvy.1997.0120.

Johansson et al., Selenocysteine in proteins-properties and biotechnological use. Biochim Biophys Acta. Oct. 30, 2005;1726(1):1-13. Epub Jun. 1, 2005.

Johns et al., The promise and peril of continuous in vitro evolution. J Mol Evol. Aug. 2005;61(2):253-63. Epub Jun. 27, 2005.

Johnson et al., Trans insertion-splicing: ribozyme-catalyzed insertion of targeted sequences into RNAs. Biochemistry. Aug. 9, 2005;44(31):10702-10. doi: 10.1021/bi0504815.

Joho et al., Identification of a region of the bacteriophage T3 and T7 RNA polymerases that determines promoter specificity. J Mol Biol. Sep. 5, 1990;215(1):31-9.

(56) References Cited

OTHER PUBLICATIONS

Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Joung et al.,TALENs: a widely applicable technology for targeted genome editing. Nat Rev Mol Cell Biol. Jan. 2013;14(1):49-55. doi: 10.1038/nrm3486. Epub Nov. 21, 2012.
Joyce et al., Amplification, mutation and selection of catalytic RNA. Gene. Oct. 15, 1989;82(1):83-7. doi: 10.1016/0378-1119(89)90033-4.
Jusiak et al., Comparison of Integrases Identifies Bxb1-GA Mutant as the Most Efficient Site-Specific Integrase System in Mammalian Cells. ACS Synth Biol. Jan. 18, 2019;8(1):16-24. doi: 10.1021/acssynbio.8b00089. Epub Jan. 9, 2019.
Jyothy et al., Translocation Down syndrome. Indian J Med Sci. Mar. 2002;56(3):122-6.
Kacian et al., Purification of the DNA polymerase of avian myeloblastosis virus. Biochim Biophys Acta. Sep. 24, 1971;246(3):365-83. doi: 10.1016/0005-2787(71)90773-8.
Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.
Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.
Kahmann et al., G inversion in bacteriophage Mu DNA is stimulated by a site within the invertase gene and a host factor. Cell. Jul. 1985;41(3):771-80. doi: 10.1016/s0092-8674(85)80058-1.
Kaiser et al., Gene therapy. Putting the fingers on gene repair. Science. Dec. 23, 2005;310(5756):1894-6.
Kakiyama et al., A peptide release system using a photo-cleavable linker in a cell array format for cell-toxicity analysis. Polymer J. Feb. 27, 2013;45:535-9.
Kalyaanamoorthy et al., ModelFinder: fast model selection for accurate phylogenetic estimates. Nat Methods. Jun. 2017;14(6):587-589. doi: 10.1038/nmeth.4285. Epub May 8, 2017.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.
Kang et al., Precision genome engineering through adenine base editing in plants. Nat Plants. Jul. 2018;4(7):427-431. doi: 10.1038/s41477-018-0178-x. Epub Jun. 4, 2018. Erratum in: Nat Plants. Sep. 2018;4(9):730.
Kao et al., Cleavage specificity of *Saccharomyces cerevisiae* flap endonuclease 1 suggests a double-flap structure as the cellular substrate. J Biol Chem. Apr. 26, 2002;277(17):14379-89. doi: 10.1074/jbc.M110662200. Epub Feb. 1, 2002.
Kappel et al., Regulating gene expression in transgenic animals. Curr Opin Biotechnol. Oct. 1992;3(5):548-53.
Karimova et al., Discovery of Nigri/nox and Panto/pox site-specific recombinase systems facilitates advanced genome engineering. Sci Rep. Jul. 22, 2016;6:30130. doi: 10.1038/srep30130.
Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.
Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.
Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.
Katafuchi et al., DNA polymerases involved in the incorporation of oxidized nucleotides into DNA: their efficiency and template base preference. Mutat Res. Nov. 28, 2010;703(1):24-31. doi: 10.1016/j.mrgentox.2010.06.004. Epub Jun. 11, 2010.
Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.
Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.
Kaufman et al., Translational efficiency of polycistronic mRNAs and their utilization to express heterologous genes in mammalian cells. EMBO J. Jan. 1987;6(1):187-93.
Kavli et al., Excision of cytosine and thymine from DNA by mutants of human uracil-DNA glycosylase. EMBO J. Jul. 1, 1996;15(13):3442-7.
Kawarasaki et al., Enhanced crossover SCRATCHY: construction and high-throughput screening of a combinatorial library containing multiple non-homologous crossovers. Nucleic Acids Res. Nov. 1, 2003;31(21):e126.
Kay et al., Viral vectors for gene therapy: the art of turning infectious agents into vehicles of therapeutics. Nat Med. Jan. 2001;7(1):33-40.
Kaya et al., A bacterial Argonaute with noncanonical guide RNA specificity. Proc. Natl. Acad. Sci. USA Apr. 2016;113(15):4057-62.
Keijzers et al., Human exonuclease 1 (EXO1) activity characterization and its function on flap structures. Biosci Rep. Apr. 25, 2015;35(3):e00206. doi: 10.1042/BSR20150058.
Kellendonk et al., Regulation of Cre recombinase activity by the synthetic steroid RU 486. Nucleic Acids Res. Apr. 15, 1996;24(8):1404-11.
Kelman, PCNA: structure, functions and interactions. Oncogene. Feb. 13, 1997;14(6):629-40. doi: 10.1038/sj.onc.1200886.
Keravala et al., A diversity of serine phage integrases mediate site-specific recombination in mammalian cells. Mol Genet Genomics. Aug. 2006;276(2):135-46. doi: 10.1007/s00438-006-0129-5. Epub May 13, 2006.
Kessel et al., Murine developmental control genes. Science. Jul. 27, 1990;249(4967):374-9. doi: 10.1126/science.1974085.
Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.
Ketha et al., Application of bioinformatics-coupled experimental analysis reveals a new transport-competent nuclear localization signal in the nucleoprotein of Influenza A virus strain. BMC Cell Biol. Apr. 28, 2008; 9:22. https://doi.org/10.1186/1471-2121-9-22.
Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.
Kilbride et al., Determinants of product topology in a hybrid Cre-Tn3 resolvase site-specific recombination system. J Mol Biol. Jan. 13, 2006;355(2):185-95. Epub Nov. 9, 2005.
Kilcher et al., Brochothrix thermosphacta bacteriophages feature heterogeneous and highly mosaic genomes and utilize unique prophage insertion sites. J Bacteriol. Oct. 2010;192(20):5441-53. doi: 10.1128/JB.00709-10. Epub Aug. 13, 2010.
Kim et al., DJ-1, a novel regulator of the tumor suppressor PTEN. Cancer Cell. 2005;7(3):263-273.
Kim et al., Genome-wide target specificity of CRISPR RNA-guided adenine base editors. Nat Biotechnol. Apr. 2019;37(4):430-435. doi: 10.1038/s41587-019-0050-1. Epub Mar. 4, 2019.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., An anionic human protein mediates cationic liposome delivery of genome editing proteins into mammalian cells. Nat Commun. Jul. 2, 2019;10(1):2905. doi: 10.1038/s41467-019-10828-3.

(56) References Cited

OTHER PUBLICATIONS

Kim et al., Evaluating and Enhancing Target Specificity of Gene-Editing Nucleases and Deaminases. Annu Rev Biochem. Jun. 20, 2019;88:191-220. doi: 10.1146/annurev-biochem-013118-111730. Epub Mar. 18, 2019.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.
Kim et al., High-throughput analysis of the activities of xCas9, SpCas9-NG and SpCas9 at matched and mismatched target sequences in human cells. Nat Biomed Eng. Jan. 2020;4(1):111-124. doi: 10.1038/s41551-019-0505-1. Epub Jan. 14, 2020.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., In vivo genome editing with a small Cas9 orthologue derived from Campylobacter jejuni. Nat Commun. Feb. 21, 2017;8:14500. doi: 10.1038/ncomms14500. PMID: 28220790; PMCID: PMC5473640.
Kim et al., In vivo high-throughput profiling of CRISPR-Cpf1 activity. Nat Methods. Feb. 2017;14(2):153-159. doi: 10.1038/nmeth.4104. Epub Dec. 19, 2016.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., Mycobacteriophage Bxb1 integrates into the *Mycobacterium smegmatis* groEL1 gene. Mol Microbiol. Oct. 2003;50(2):463-73. doi: 10.1046/j.1365-2958.2003.03723.x.
Kim et al., Rescue of high-specificity Cas9 variants using sgRNAs with matched 5' nucleotides. Genome Biol. Nov. 15, 2017;18(1):218. doi: 10.1186/s13059-017-1355-3.
Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Kim et al., The role of apolipoprotein E in Alzheimer's disease. Neuron. Aug. 13, 2009;63(3):287-303. doi: 10.1016/j.neuron.2009.06.026.
Kim et al., Transcriptional repression by zinc finger peptides. Exploring the potential for applications in gene therapy. J Biol Chem. Nov. 21, 1997;272(47):29795-800.
King et al., No gain, no pain: NaV1.7 as an analgesic target. ACS Chem Neurosci. Sep. 17, 2014;5(9):749-51. doi: 10.1021/cn500171p. Epub Aug. 11, 2014.
Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Klapacz et al., Frameshift mutagenesis and microsatellite instability induced by human alkyladenine DNA glycosylase. Mol Cell. Mar. 26, 2010;37(6):843-53. doi: 10.1016/j.molcel.2010.01.038.

Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.
Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5 and Supplementary Materials. doi: 10.1038/nature14592. Epub Jun. 22, 2015. 27 pages.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.
Kluesner et al., CRISPR-Cas9 cytidine and adenosine base editing of splice-sites mediates highly-efficient disruption of proteins in primary and immortalized cells. Nat Commun. Apr. 23, 2021;12(1):2437. doi: 10.1038/s41467-021-22009-2.
Knott et al., Guide-bound structures of an RNA-targeting A-cleaving CRISPR-Cas13a enzyme. Nat Struct Mol Biol. Oct. 2017;24(10):825-833. doi: 10.1038/nsmb.3466. Epub Sep. 11, 2017.
Koblan et al., In vivo base editing rescues Hutchinson-Gilford progeria syndrome in mice. Nature. Jan. 2021;589(7843):608-614. doi: 10.1038/s41586-020-03086-7. Epub Jan. 6, 2021.
Koblan et al., Efficient CoG-to-GoC base editors developed using CRISPRi screens, target-library analysis, and machine learning. Nature Biotechnol. Jun. 28, 2021. https://doi.org/10.1038/s41587-021-00938-z.
Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.
Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.
Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.
Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.

(56) References Cited

OTHER PUBLICATIONS

Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.
Kolot et al., Site promiscuity of coliphage HK022 integrase as a tool for gene therapy. Gene Ther. Jul. 2015;22(7):521-7. doi: 10.1038/gt.2015.9. Epub Mar. 12, 2015.
Kolot et al., Site-specific recombination in mammalian cells expressing the Int recombinase of bacteriophage HK022. Mol Biol Rep. Aug. 1999;26(3):207-13. doi: 10.1023/a:1007096701720.
Komor et al., CRISPR-Based Technologies for the Manipulation of Eukaryotic Genomes. Cell. Jan. 12, 2017;168(1-2):20-36. doi: 10.1016/j.cell.2016.10.044.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Komor et al., Programmable editing of a target base in genomic DNA without double-stranded DNA cleavage. Nature. Apr. 20, 2016;533(7603):420-4. doi: 10.1038/nature17946.
Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.
Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.
Koonin et al., Diversity, classification and evolution of CRISPR-Cas systems. Curr Opin Microbiol. 2017;37:67?78. doi:10.1016/j.mib.2017.05.008.
Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.
Kotewicz et al., Cloning and overexpression of Moloney murine leukemia virus reverse transcriptase in *Escherichia coli*. Gene. 1985;35(3):249-58. doi: 10.1016/0378-1119(85)90003-4.
Kotewicz et al., Isolation of cloned Moloney murine leukemia virus reverse transcriptase lacking ribonuclease H activity. Nucleic Acids Res. Jan. 11, 1988;16(1):265-77. doi: 10.1093/nar/16.1.265.
Kotin, Prospects for the use of adeno-associated virus as a vector for human gene therapy. Hum Gene Ther. Jul. 1994;5(7):793-801. doi: 10.1089/hum.1994.5.7-793.
Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kowal et al., Exploiting unassigned codons in Micrococcus luteus for tRNA-based amino acid mutagenesis. Nucleic Acids Res. Nov. 15, 1997;25(22):4685-9.
Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.
Kozak, An analysis of 5'-noncoding sequences from 699 vertebrate messenger RNAs. Nucleic Acids Res. Oct. 26, 1987;15(20):8125-48. doi: 10.1093/nar/15.20.8125.
Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.
Kremer et al., Adenovirus and adeno-associated virus mediated gene transfer. Br Med Bull. Jan. 1995;51(1):31-44. doi: 10.1093/oxfordjournals.bmb.a072951.
Krokan et al., Uracil in DNA—occurrence, consequences and repair. Oncogene. Dec. 16, 2002;21(58):8935-48. doi: 10.1038/sj.onc.1205996.
Krokan et al., Base excision repair. Cold Spring Harb Perspect Biol. Apr. 1, 2013;5(4):a012583. doi: 10.1101/cshperspect.a012583.
Krzywkowski et al., Limited reverse transcriptase activity of phi29 DNA polymerase. Nucleic Acids Res. Apr. 20, 2018;46(7):3625-3632. doi: 10.1093/nar/gky190.
Kumar et al., Gene therapy for chronic neuropathic pain: how does it work and where do we stand today? Pain Med. May 2011;12(5):808-22. doi: 10.1111/j.1526-4637.2011.01120.x.
Kumar et al., Structural and functional consequences of the mutation of a conserved arginine residue in alphaA and alphaB crystallins. J Biol Chem. Aug. 20, 1999;274(34):24137-41.
Kundu et al., Leucine to proline substitution by SNP at position 197 in Caspase-9 gene expression leads to neuroblastoma: a bioinformatics analysis. 3 Biotech. 2013; 3:225-34.
Kunkel et al., Eukaryotic Mismatch Repair in Relation to DNA Replication. Annu Rev Genet. 2015;49:291-313. doi: 10.1146/annurev-genet-112414-054722.
Kunz et al., DNA Repair in mammalian cells: Mismatched repair: variations on a theme. Cell Mol Life Sci. Mar. 2009;66(6):1021-38. doi: 10.1007/s00018-009-8739-9.
Kurjan et al., Structure of a yeast pheromone gene (MF alpha): a putative alpha-factor precursor contains four tandem copies of mature alpha-factor. Cell. Oct. 1982;30(3):933-43. doi: 10.1016/0092-8674(82)90298-7.
Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.
Kuscu et al., CRISPR-Cas9-AID base editor is a powerful gain-of-function screening tool. Nat Methods. Nov. 29, 2016;13(12):983-984. doi: 10.1038/nmeth.4076.
Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.
Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.
Kwart et al., Precise and efficient scarless genome editing in stem cells using Correct. Nat Protoc. Feb. 2017;12(2):329-354. doi: 10.1038/nprot.2016.171. Epub Jan. 19, 2017.
Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.
Kwon et al., Chemical basis of glycine riboswitch cooperativity. RNA. Jan. 2008;14(1):25-34. Epub Nov. 27, 2007.
Köhrer et al., A possible approach to site-specific insertion of two different unnatural amino acids into proteins in mammalian cells via nonsense suppression. Chem Biol. Nov. 2003;10(11):1095-102.
Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.
Kügler et al., Human synapsin 1 gene promoter confers highly neuron-specific long-term transgene expression from an adenoviral vector in the adult rat brain depending on the transduced area. Gene Ther. Feb. 2003;10(4):337-47. doi: 10.1038/sj.gt.3301905.
Lada et al., Mutator effects and mutation signatures of editing deaminases produced in bacteria and yeast. Biochemistry (Mosc). Jan. 2011;76(1):131-46.
Lakich et al., Inversions disrupting the factor VIII gene are a common cause of severe haemophilia A. Nat Genet. Nov. 1993;5(3):236-41. doi: 10.1038/ng1193-236.
Lancaster et al., Limited trafficking of a neurotropic virus through inefficient retrograde axonal transport and the type I interferon response. PLoS Pathog. Mar. 5, 2010;6(3):e1000791. doi: 10.1371/journal.ppat.1000791.
Landrum et al., Clin Var: public archive of interpretations of clinically relevant variants. Nucleic Acids Res. Jan. 4, 2016;44(D1):D862-8. doi: 10.1093/nar/gkv1222. Epub Nov. 17, 2015.

(56) References Cited

OTHER PUBLICATIONS

Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.
Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.
Langer et al., New methods of drug delivery. Science. Sep. 28, 1990;249(4976):1527-33.
Lapinaite et al., DNA capture by a CRISPR-Cas9-guided adenine base editor. Science. Jul. 31, 2020;369(6503):566-571. doi: 10.1126/science.abb1390.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.
Lau et al., Molecular basis for discriminating between normal and damaged bases by the human alkyladenine glycosylase, AAG. Proc Natl Acad Sci U S A. Dec. 5, 2000;97(25):13573-8.
Lauer et al., Construction, characterization, and use of two Listeria monocytogenes site-specific phage integration vectors. J Bacteriol. Aug. 2002;184(15):4177-86. doi: 10.1128/jb.184.15.4177-4186.2002.
Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.
Lawrence et al., Supercharging proteins can impart unusual resilience. J Am Chem Soc. Aug. 22, 2007;129(33):10110-2. Epub Aug. 1, 2007.
Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.
Lazar et al., Transforming growth factor alpha: mutation of aspartic acid 47 and leucine 48 results in different biological activities. Mol Cell Biol. Mar. 1988;8(3):1247-52.
Lazarevic et al., Nucleotide sequence of the Bacillus subtilis temperate bacteriophage SPbetac2. Microbiology (Reading). May 1999;145 ( Pt 5):1055-1067. doi: 10.1099/13500872-145-5-1055.
Le Grice et al., Purification and characterization of recombinant equine infectious anemia virus reverse transcriptase. J Virol. Dec. 1991;65(12):7004-7. doi: 10.1128/JVI.65.12.7004-7007.1991.
Leaver-Fay et al., Rosetta3: an object-oriented software suite for the simulation and design of macromolecules. Methods Enzymol. 2011;487:545-74. doi: 10.1016/B978-0-12-381270-4.00019-6.
Leconte et al., A population-based experimental model for protein evolution: effects of mutation rate and selection stringency on evolutionary outcomes. Biochemistry. Feb. 26, 2013;52(8):1490-9. doi: 10.1021/bi3016185. Epub Feb. 14, 2013.
Ledford, Gene-editing hack yields pinpoint precision. Nature, Apr. 20, 2016. http://www.nature.com/news/gene-editing-hack-yields-pinpoint-precision-1.19773.
Lee et al., A chimeric thyroid hormone receptor constitutively bound to DNA requires retinoid X receptor for hormone-dependent transcriptional activation in yeast. Mol Endocrinol. Sep. 1994;8(9):1245-52.
Lee et al., A monoclonal antibody that targets a NaV1.7 channel voltage sensor for pain and itch relief. Cell. Jun. 5, 2014;157(6):1393-1404. doi: 10.1016/j.cell.2014.03.064. Epub May 22, 2014. Retraction in: Cell. Jun. 25, 2020;181(7):1695.
Lee et al., An allosteric self-splicing ribozyme triggered by a bacterial second messenger. Science. Aug. 13, 2010;329(5993):845-8. doi: 10.1126/science.1190713.
Lee et al., Failure to detect DNA-guided genome editing using Natronobacterium gregoryi Argonaute. Nat Biotechnol. Nov. 28, 2016;35(1):17-18. doi: 10.1038/nbt.3753.
Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.
Lee et al., PIK3CA gene is frequently mutated in breast carcinomas and hepatocellular carcinomas. Oncogene. Feb. 17, 2005;24(8):1477-80.
Lee et al., Recognition of liposomes by cells: in vitro binding and endocytosis mediated by specific lipid headgroups and surface charge density. Biochim Biophys Acta. Jan. 31, 1992;1103(2):185-97.
Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.
Lee et al., Simultaneous targeting of linked loci in mouse embryos using base editing. Sci Rep. Feb. 7, 2019;9(1):1662. doi: 10.1038/s41598-018-33533-5.
Lee et al., Site-specific integration of mycobacteriophage L5: integration-proficient vectors for *Mycobacterium smegmatis, Mycobacterium tuberculosis*, and bacille Calmette-Guérin. Proc Natl Acad Sci U S A. Apr. 15, 1991;88(8):3111-5. doi: 10.1073/pnas.88.8.3111.
Lee et al., Synthetically modified guide RNA and donor DNA are a versatile platform for CRISPR-Cas9 engineering. Elife. May 2, 2017;6:e25312. doi: 10.7554/eLife.25312.
Lee et al., Targeted chromosomal deletions in human cells using zinc finger nucleases. Genome Res. Jan. 2010 20: 81-89; Published in Advance Dec. 1, 2009, doi:10.1101/gr.099747.109.
Lee et al., Targeting fidelity of adenine and cytosine base editors in mouse embryos. Nat Commun. Nov. 15, 2018;9(1):4804. doi: 10.1038/s41467-018-07322-7.
Lee et al., Transcriptional regulation and its misregulation in disease. Cell. Mar. 14, 2013;152(6):1237-51. doi: 10.1016/j.cell.2013.02.014.
Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.
Lei et al., Site-specificity of serine integrase demonstrated by the attB sequence preference of ?BT1 integrase. FEBS Lett. Apr. 2018;592(8):1389-1399. doi: 10.1002/1873-3468.13023. Epub Mar. 25, 2018.
Leipold et al., A de novo gain-of-function mutation in SCN11A causes loss of pain perception. Nat Genet. Nov. 2013;45(11):1399-404. doi: 10.1038/ng.2767. Epub Sep. 15, 2013.
Lemos et al., CRISPR/Cas9 cleavages in budding yeast reveal templated insertions and strand-specific insertion/deletion profiles. Proc Natl Acad Sci U S A. Feb. 27, 2018;115(9):E2040-E2047. doi: 10.1073/pnas.1716855115. Epub Feb. 13, 2018.
Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.
Levy et al., Cytosine and adenine base editing of the brain, liver, retina, heart and skeletal muscle of mice via adeno-associated viruses. Nat Biomed Eng. 2020;4(1):97-110. doi: 10.1038/s41551-019-0501-5.
Levy et al., Inhibition of calcification of bioprosthetic heart valves by local controlled-release diphosphonate. Science. Apr. 12, 1985;228(4696):190-2.
Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.
Lew et al., Protein splicing in vitro with a semisynthetic two-component minimal intein. J Biol Chem. Jun. 26, 1998;273(26):15887-90. doi: 10.1074/jbc.273.26.15887.
Lewis et al., A serum-resistant cytofectin for cellular delivery of antisense oligodeoxynucleotides and plasmid DNA. Proc Natl Acad Sci U S A. Apr. 16, 1996;93(8):3176-81.
Lewis et al., Building the Class 2 CRISPR-Cas Arsenal. Mol Cell 2017;65(3);377-379.

(56) References Cited

OTHER PUBLICATIONS

Lewis et al., Codon 129 polymorphism of the human prion protein influences the kinetics of amyloid formation. J Gen Virol. Aug. 2006;87(Pt 8):2443-9.

Lewis et al., Cytosine deamination and the precipitous decline of spontaneous mutation during Earth's history. Proc Natl Acad Sci U S A. Jul. 19, 2016;113(29):8194-9. doi: 10.1073/pnas.1607580113. Epub Jul. 5, 2016.

Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.

Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.

Li et al., Base editing with a Cpf1-cytidine deaminase fusion. Nat Biotechnol. Apr. 2018;36(4):324-327. doi: 10.1038/nbt.4102. Epub Mar. 19, 2018.

Li et al., Current approaches for engineering proteins with diverse biological properties. Adv Exp Med Biol. 2007;620:18-33.

Li et al., Disruption of splicing-regulatory elements using CRISPR/Cas9 to rescue spinal muscular atrophy in human iPSCs and mice. National Science Review. Jan. 1, 2020:92-101. DOI: 10.1093/nsr/nwz131. Retrieved from the Internet via https://academic.oup.com/nsr/article-pdf/7/1/92/33321439/nwz131.pdf. Last accessed Apr. 28, 2021.

Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.

Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.

Li et al., Highly efficient and precise base editing in discarded human tripronuclear embryos. Protein Cell. Aug. 19, 2017. doi: 10.1007/s13238-017-0458-7. [Epub ahead of print].

Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.

Li et al., Loss of post-translational modification sites in disease. Pac Symp Biocomput. 2010:337-47. doi: 10.1142/9789814295291_0036.

Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.

Li et al., Multiplex and homologous recombination-mediated genome editing in *Arabidopsis* and *Nicotiana benthamiana* using guide RNA and Cas9. Nat Biotechnol. Aug. 2013;31(8):688-91. doi: 10.1038/nbt.2654.

Li et al., Precise Modifications of Both Exogenous and Endogenous Genes in Rice by Prime Editing. Mol Plant. May 4, 2020;13(5):671-674. doi: 10.1016/j.molp.2020.03.011. Epub Mar. 25, 2020.

Li et al., Protein trans-splicing as a means for viral vector-mediated in vivo gene therapy. Hum Gene Ther. Sep. 2008;19(9):958-64. doi: 10.1089/hum.2008.009.

Li et al., RSEM: accurate transcript quantification from RNA-Seq data with or without a reference genome. BMC Bioinformatics. Aug. 4, 2011;12:323. doi: 10.1186/1471-2105-12-323.

Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.

Li, Mechanisms and functions of DNA mismatch repair. Cell Res. Jan. 2008;18(1):85-98. doi: 10.1038/cr.2007.115.

Liang et al., Correction of ?-thalassemia mutant by base editor in human embryos. Protein Cell. Nov. 2017;8(11):811-822. doi: 10.1007/s13238-017-0475-6. Epub Sep. 23, 2017.

Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.

Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.

Lieber et al., Mechanism and regulation of human non-homologous DNA end-joining. Nat Rev Mol Cell Biol. Sep. 2003;4(9):712-20.

Liefke et al., The oxidative demethylase ALKBH3 marks hyperactive gene promoters in human cancer cells. Genome Med. Jun. 30, 2015;7(1):66. doi: 10.1186/s13073-015-0180-0.

Lienert et al., Two- and three-input TALE-based AND logic computation in embryonic stem cells. Nucleic Acids Res. Nov. 2013;41(21):9967-75. doi: 10.1093/nar/gkt758. Epub Aug. 27, 2013.

Lilley, D.M. The Varkud Satellite Ribozyme. RNA. Feb. 2004;10(2):151-8.doi: 10.1261/rna.5217104.

Lim et al., Crystal structure of the moloney murine leukemia virus RNase H domain. J Virol. Sep. 2006;80(17):8379-89. doi: 10.1128/JVI.00750-06.

Lim et al., Viral vectors for neurotrophic factor delivery: a gene therapy approach for neurodegenerative diseases of the CNS. Pharmacol Res. Jan. 2010;61(1):14-26. doi: 10.1016/j.phrs.2009.10.002. Epub Oct. 17, 2009.

Lin et al., Enhanced homology-directed human genome engineering by controlled timing of CRISPR/Cas9 delivery. Elife. Dec. 15, 2014;3:e04766. doi: 10.7554/eLife.04766.

Lin et al., High-efficiency prime editing with optimized, paired pegRNAs in plants. Nat Biotechnol. Aug. 2021;39(8):923-927. doi: 10.1038/s41587-021-00868-w. Epub Mar. 25, 2021.

Lin et al., Prime genome editing in rice and wheat. Nat Biotechnol. May 2020;38(5):582-585 and Supplemental Info. doi: 10.1038/s41587-020-0455-x. Epub Mar. 16, 2020. 8 pages.

Lin et al., Prime genome editing in rice and wheat. Nat Biotechnol. May 2020;38(5):582-585. doi: 10.1038/s41587-020-0455-x. Epub Mar. 16, 2020.

Lin et al., The human REV1 gene codes for a DNA template-dependent dCMP transferase. Nucleic Acids Res. Nov. 15, 1999;27(22):4468-75. doi: 10.1093/nar/27.22.4468.

Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.

Liu et al., C2c1-sgRNA Complex Structure Reveals RNA-Guided DNA Cleavage Mechanism. Molecular Cell Jan. 2017;65(2):310-22.

Liu et al., Split dnaE genes encoding multiple novel inteins in Trichodesmium erythraeum. J Biol Chem. Jul. 18, 2003;278(29):26315-8. doi: 10.1074/jbc.C300202200. Epub May 24, 2003.

Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.

Liu et al., Adding new chemistries to the genetic code. Annu Rev Biochem. 2010;79:413-44. doi: 10.1146/annurev.biochem.052308.105824.

Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.

Liu et al., Balancing AID and DNA repair during somatic hypermutation. Trends Immunol. Apr. 2009;30(4):173-81. doi: 10.1016/j.it.2009.01.007.

Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.

Liu et al., CasX enzymes comprise a distinct family of RNA-guided genome editors. Nature. Feb. 2019;566(7743):218-223. doi: 10.1038/s41586-019-0908-x. Epub Feb. 4, 2019. Author manuscript entitled CRISPR-CasX is an RNA-dominated enzyme active for human genome editing.

Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.

Liu et al., Computational approaches for effective CRISPR guide RNA design and evaluation. Comput Struct Biotechnol J. Nov. 29, 2019;18:35-44. doi: 10.1016/j.csbj.2019.11.006.

(56) References Cited

OTHER PUBLICATIONS

Liu et al., Design of polydactyl zinc-finger proteins for unique addressing within complex genomes. Proc Natl Acad Sci U S A. May 27, 1997;94(11):5525-30.

Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.

Liu et al., Distance determination by GIY-YIG intron endonucleases: discrimination between repression and cleavage functions. Nucleic Acids Res. Mar. 31, 2006;34(6):1755-64. Print 2006.

Liu et al., Editing DNA Methylation in the Mammalian Genome. Cell. Sep. 22, 2016;167(1):233- 247.e17. doi: 10.1016/j.cell.2016.08.056.

Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.

Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.

Liu et al., Fast Colorimetric Sensing of Adenosine and Cocaine Based on a General Sensor Design Involving Aptamers and Nanoparticles. Angew Chem. 2006;118(1):96-100.

Liu et al., Flap endonuclease 1: a central component of DNA metabolism. Annu Rev Biochem. 2004;73:589-615. doi:10.1146/annurev.biochem.73.012803.092453.

Liu et al., Functional Nucleic Acid Sensors. Chem Rev. May 2009;109(5):1948-98. doi: 10.1021/cr030183i.

Liu et al., Genetic incorporation of unnatural amino acids into proteins in mammalian cells. Nat Methods. Mar. 2007;4(3):239-44. Epub Feb. 25, 2007.

Liu et al., Highly efficient RNA-guided base editing in rabbit. Nat Commun. Jul. 13, 2018;9(1):2717. doi: 10.1038/s41467-018-05232-2.

Liu et al., (6)-methyladenosine-dependent RNA structural switches regulate RNA-protein interactions. Nature. Feb. 26, 2015;518(7540):560-4. doi: 10.1038/nature14234.

Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.

Liu et al., Reverse transcriptase of foamy virus. Purification of the enzymes and immunological identification. Arch Virol. 1977;55(3):187-200. doi: 10.1007/BF01319905.

Liu et al., Reverse transcriptase-mediated tropism switching in Bordetella bacteriophage. Science. Mar. 15, 2002;295(5562):2091-4. doi: 10.1126/science.1067467.

Liu et al., *Saccharomyces cerevisiae* flap endonuclease 1 uses flap equilibration to maintain triplet repeat stability. Mol Cell Biol. May 2004;24(9):4049-64. doi: 10.1128/MCB.24.9.4049-4064.2004.

Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.

Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.

Lombardo et al., Gene editing in human stem cells using zinc finger nucleases and integrase-defective lentiviral vector delivery. Nat Biotechnol. Nov. 2007;25(11):1298-306. Epub Oct. 28, 2007.

Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.

Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.

Lorenz et al., ViennaRNA Package 2.0. Algorithms Mol Biol. Nov. 24, 2011;6:26. doi: 10.1186/1748-7188-6-26.

Losey et al., Crystal structure of *Staphylococcus sureus* tRNA adenosine deaminase tadA in complex with RNA. Nature Struct. Mol. Biol. Feb. 2006;13(2):153-9.

Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.

Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.

Luckow et al., High level expression of nonfused foreign genes with Autographa californica nuclear polyhedrosis virus expression vectors. Virology. May 1989;170(1):31-9. doi: 10.1016/0042-6822(89)90348-6.

Lukacsovich et al., Repair of a specific double-strand break generated within a mammalian chromosome by yeast endonuclease I-SceI. Nucleic Acids Res. Dec. 25, 1994;22(25):5649-57. doi: 10.1093/nar/22.25.5649.

Lundberg et al., Delivery of short interfering RNA using endosomolytic cell-penetrating peptides. FASEB J. Sep. 2007;21(11):2664-71. Epub Apr. 26, 2007.

Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.

Lynch, Evolution of the mutation rate. Trends Genet. Aug. 2010;26(8):345-52. doi: 10.1016/j.tig.2010.05.003. Epub Jun. 30, 2010.

Lyons et al., Efficient Recognition of an Unpaired Lesion by a DNA Repair Glycosylase. J. Am. Chem. Soc., 2009;131(49):17742-3. DOI: 10.1021/ja908378y.

Lüke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.

Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.

Ma et al., In vitro protein engineering using synthetic tRNA(A1a) with different anticodons. Biochemistry. Aug. 10, 1993;32(31):7939-45.

Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.

Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.

Ma et al., Targeted AID-mediated mutagenesis (TAM) enables efficient genomic diversification in mammalian cells. Nature Methods. Oct. 2016;13:1029-35. doi:10.1038/nmeth.4027.

Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.

Macbeth et al., Inositol hexakisphosphate is bound in the ADAR2 core and required for RNA editing. Science. Sep. 2, 2005;309(5740):1534-9. doi: 10.1126/science.1113150.

Macrae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.

Madura et al., Structural basis for ineffective T-cell responses to MHC anchor residue-improved "heteroclitic" peptides. Eur J Immunol. Feb. 2015;45(2):584-91. doi:. 10.1002/eji.201445114. Epub Dec. 28, 2014.

Maeder et al., CRISPR RNA-guided activation of endogenous human genes. Nat Methods. Oct. 2013;10(10):977-9. doi: 10.1038/nmeth.2598. Epub Jul. 25, 2013.

Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.

(56) References Cited

OTHER PUBLICATIONS

Maeder et al., Robust, synergistic regulation of human gene expression using TALE activators. Nat Methods. Mar. 2013;10(3):243-5. doi: 10.1038/nmeth.2366. Epub Feb. 10, 2013.

Magin et al., Corf, the Rev/Rex homologue of HTDV/HERV-K, encodes an arginine-rich nuclear localization signal that exerts a trans-dominant phenotype when mutated. Virology. Aug. 15, 2000;274(1):11-6. doi: 10.1006/viro.2000.0438.

Mahfouz et al., De novo-engineered transcription activator-like effector (TALE) hybrid nuclease with novel Dna binding specificity creates double-strand breaks. Proc Natl Acad Sci U S A. Feb. 8, 2011;108(6):2623-8. doi: 10.1073/pnas.1019533108. Epub Jan. 24, 2011.

Maizels et al., Initiation of homologous recombination at DNA nicks. Nucleic Acids Res. Aug. 21, 2018;46(14):6962-6973. doi: 10.1093/nar/gky588.

Maji et al., A High-Throughput Platform to Identify Small-Molecule Inhibitors of CRISPR-Cas9. Cell. May 2, 2019;177(4):1067-1079. e19. doi: 10.1016/j.cell.2019.04.009.

Makarova et al., Prokaryotic homologs of Argonaute proteins are predicted to function as key components of a novel system of defense against mobile genetic elements. Biology Direct 2009;4:29.

Makarova et al., An updated evolutionary classification of CRISPR-Cas systems. Nat Rev Microbiol. Nov. 2015;13(11):722-36. doi: 10.1038/nrmicro3569. Epub Sep. 28, 2015.

Makarova et al., Classification and Nomenclature of CRISPR-Cas Systems: Where from Here? CRISPR J. Oct. 2018;1(5):325-336. doi: 10.1089/crispr.2018.0033.

Makarova et al., Evolution and classification of the CRISPR-Cas systems. Nat Rev Microbiol. Jun. 2011;9(6):467-77. doi: 10.1038/nrmicro2577. Epub May 9, 2011.

Makarova et al., Prokaryotic homologs of Argonaute proteins are predicted to function as key components of a novel system of defense against mobile genetic elements. Biology Direct 2009;4:29. doi: 10.1186/1745-6150-4-29.

Makeyev et al., Evolutionary potential of an RNA virus. J Virol. Feb. 2004;78(4):2114-20.

Malashkevich et al., Crystal structure of tRNA adenosine deaminase TadA from *Escherichia coli*. Deposited: Mar. 10, 2005 Released: Feb. 21, 2006 doi:10.2210/pdb1z3a/pdb (2006).

Mali et al., Cas9 as a versatile tool for engineeringbiology. Nat Methods. Oct. 2013;10(10):957-63. doi: 10.1038/nmeth.2649.

Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.

Mali et al., RNA-guided human genome engineering via Cas9. Science. Feb. 15, 2013;339(6121):823-6. doi: 10.1126/science.1232033. Epub Jan. 3, 2013.

Malito et al., Structural basis for lack of toxicity of the diphtheria toxin mutant CRM197. Proc Natl Acad Sci U S A. Apr. 3, 2012;109(14):5229-34. doi: 10.1073/pnas.1201964109. Epub Mar. 19, 2012.

Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.

Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.

Mani et al., Design, engineering, and characterization of zinc finger nucleases. Biochem Biophys Res Commun. Sep. 23, 2005;335(2):447-57.

Marceau, Functions of single-strand DNA-binding proteins in DNA replication, recombination, and repair. Methods Mol Biol. 2012;922:1-21. doi: 10.1007/978-1-62703-032-8_1.

Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.

Marioni et al., DNA methylation age of blood predicts all-cause mortality in later life. Genome Biol. Jan. 30, 2015;16:25. doi: 10.1186/s13059-015-0584-6.

Marquart et al., Predicting base editing outcomes with an attention-based deep learning algorithm trained on high-throughput target library screeen. bioRxiv. Jul. 5, 2020. DOI: 10.1101/2020.07.05.186544. Retrieved from the Internet via https://www.biorxiv.org/content/10.1101/2020.07.05.186544v1.full.pdf lased accessed on Apr. 28, 2021.

Marraffini et al., CRISPR interference limits horizontal gene transfer in staphylococci by targeting DNA. Science. Dec. 19, 2008;322(5909):1843-5. doi: 10.1126/science.1165771.

Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.

Martsolf et al., Complete trisomy 17p a relatively new syndrome. Ann Genet. 1988;31(3):172-4.

Martz, L., Nav-i-gating antibodies for pain. Science-Business eXchange. Jun. 12, 2014;7(662):1-2. doi: 10.1038/scibx.2014.662.

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Marzec et al., Prime Editing: A New Way for Genome Editing. Trends Cell Biol. Apr. 2020;30(4):257-259. doi: 10.1016/j.tcb.2020.01.004. Epub Jan. 27, 2020.

Mascola et al., HIV-1 neutralizing antibodies: understanding nature's pathways. Immunol Rev. Jul. 2013;254(1):225-44. doi: 10.1111/imr.12075.

Mathys et al., Characterization of a self-splicing mini-intein and its conversion into autocatalytic- and C-terminal cleavage elements: facile production of protein building blocks for protein ligation. Gene. Apr. 29, 1999;231(1-2):1-13. doi: 10.1016/s0378-1119(99)00103-1.

Matsuura et al., A gene essential for the site-specific excision of actinophage r4 prophage genome from the chromosome of a lysogen. J Gen Appl Microbiol. 1995;41(1):53-61.

Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.

May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.

McCarroll et al., Copy-number variation and association studies of human disease. Nat Genet. Jul. 2007;39(7 Suppl):S37-42. doi: 10.1038/ng2080.

McDonald et al., Characterization of mutations at the mouse phenylalanine hydroxylase locus. Genomics. Feb. 1, 1997;39(3):402-5. doi: 10.1006/geno.1996.4508.

McInerney et al., Error Rate Comparison during Polymerase Chain Reaction by DNA Polymerase. Mol Biol Int. 2014;2014:287430. doi: 10.1155/2014/287430. Epub Aug. 17, 2014.

McKenna et al., Recording development with single cell dynamic lineage tracing. Development. Jun. 27, 2019;146(12):dev169730. doi: 10.1242/dev.169730.

McKenna et al., Whole-organism lineage tracing by combinatorial and cumulative genome editing. Science. Jul. 29, 2016;353(6298):aaf7907. doi: 10.1126/science.aaf7907. Epub May 26, 2016.

McNaughton et al., Mammalian cell penetration, siRNA transfection, and DNA transfection by supercharged proteins. Proc Natl Acad Sci U S A. Apr. 14, 2009;106(15):6111-6. doi: 10.1073/pnas.0807883106. Epub Mar. 23, 2009.

McVey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.

Mead et al., A novel protective prion protein variant that colocalizes with kuru exposure. Engl J Med. Nov. 19, 2009;361(21):2056-65. doi: 10.1056/NEJMoa0809716.

(56) References Cited

OTHER PUBLICATIONS

Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.

Meinke et al., Cre Recombinase and Other Tyrosine Recombinases. Chem Rev. Oct. 26, 2016;116(20):12785-12820. doi: 10.1021/acs.chemrev.6b00077. Epub May 10, 2016.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Menéndez-Arias, Mutation rates and intrinsic fidelity of retroviral reverse transcriptases. Viruses. Dec. 2009;1(3):1137-65. doi: 10.3390/v1031137. Epub Dec. 4, 2009.

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Mertens et al., Site-specific recombination in bacteriophage Mu: characterization of binding sites for the DNA invertase Gin. EMBO J. Apr. 1988;7(4):1219-27.

Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.

Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.

Meyer et al., Confirmation of a second natural preQ1 aptamer class in Streptococcaceae bacteria. RNA. Apr. 2008;14(4):685-95. doi: 10.1261/rna.937308. Epub Feb. 27, 2008.

Meyer et al., Library generation by gene shuffling. Curr Protoc Mol Biol. Jan. 6, 2014;105:Unit 15.12.. doi: 10.1002/0471142727.mb1512s105.

Meyer et al., Ribosome biogenesis factor Tsr3 is the aminocarboxypropyl transferase responsible for 18S rRNA hypermodification in yeast and humans. Nucleic Acids Res. May 19, 2016;44(9):4304-16. doi: 10.1093/nar/gkw244. Epub Apr. 15, 2016.

Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.

Michel et al., Mitochondrial class II introns encode proteins related to the reverse transcriptases of retroviruses. Nature. Aug. 15-21, 1985;316(6029):641-3. doi: 10.1038/316641a0.

Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.

Mihai et al., PTEN inhibition improves wound healing in lung epithelia through changes in cellular mechanics that enhance migration. Am J Physiol Lung Cell Mol Physiol. 2012;302(3):L287-L299.

Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.

Miller et al., A TALE nuclease architecture for efficient genome editing. Nat Biotechnol. Feb. 2011;29(2):143-8. doi:10.1038/nbt.1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Miller et al., Construction and properties of retrovirus packaging cells based on gibbon ape leukemia virus. J Virol. May 1991;65(5):2220-4. doi: 10.1128/JVI.65.5.2220-2224.1991.

Miller et al., Continuous evolution of SpCas9 variants compatible with non-G PAMs. Nat Biotechnol. Apr. 2020;38(4):471-481. doi: 10.1038/s41587-020-0412-8. Epub Feb. 10, 2020.

Miller et al., Phage-assisted continuous and non-continuous evolution. Nat Protoc. Dec. 2020;15(12):4101-4127. doi: 10.1038/s41596-020-00410-3. Epub Nov. 16, 2020.

Miller, Human gene therapy comes of age. Nature. Jun. 11, 1992;357(6378):455-60. doi: 10.1038/357455a0.

Mills et al., Protein splicing in trans by purified- and C-terminal fragments of the *Mycobacterium tuberculosis* RecA intein. Proc Natl Acad Sci U S A. Mar. 31, 1998;95(7):3543-8. doi: 10.1073/pnas.95.7.3543.

Minoche et al., Evaluation of genomic high-throughput sequencing data generated on Illumina HiSeq and genome analyzer systems. Genome Biol. Nov. 8, 2011;12(11):R112. doi: 10.1186/gb-2011-12-11-r112.

Minoretti et al., A W148R mutation in the human FOXD4 gene segregating with dilated cardiomyopathy, obsessive-compulsive disorder, and suicidality. Int J Mol Med. Mar. 2007;19(3):369-72.

Mir et al., Two Active Site Divalent Ions in the Crystal Structure of the Hammerhead Ribozyme Bound to a Transition State Analogue. Biochemistry. . Feb. 2, 2016;55(4):633-6. doi: 10.1021/acs.biochem.5b01139. Epub Jan. 19, 2016.

Mir et al., Type II-C CRISPR-Cas9 Biology, Mechanism, and Application. ACS Chem Biol. Feb. 16, 2018;13(2):357-365. doi: 10.1021/acschembio.7b00855. Epub Dec. 20, 2017.

Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.

Mitani et al., Delivering therapeutic genes—matching approach and application. Trends Biotechnol. May 1993;11(5):162-6. doi: 10.1016/0167-7799(93)90108-L.

Mitton-Fry et al., Poly(A) tail recognition by a viral RNA element through assembly of a triple helix. Science. Nov. 26, 2010;330(6008):1244-7. doi: 10.1126/science.1195858.

Miyaoka et al., Systematic quantification of HDR and NHEJ reveals effects of locus, nuclease, and cell type on genome-editing. Sci Rep. Mar. 31, 2016;6:23549. doi: 10.1038/srep23549.

Moede et al., Identification of a nuclear localization signal, RRMKWKK, in the homeodomain transcription factor PDX-1. FEBS Lett. Nov. 19, 1999;461(3):229-34. doi: 10.1016/s0014-5793(99)01446-5.

Mohr et al., A Reverse Transcriptase-Cas1 Fusion Protein Contains a Cas6 Domain Required for Both CRISPR RNA Biogenesis and RNA Spacer Acquisition. Mol Cell. Nov. 15, 2018;72(4):700-714.e8. doi: 10.1016/j.molcel.2018.09.013. Epub Oct. 18, 2018. Including Supplemental Information.

Mohr et al., Thermostable group II intron reverse transcriptase fusion proteins and their use in cDNA synthesis and next-generation RNA sequencing. RNA. Jul. 2013;19(7):958-70. doi: 10.1261/rna.039743.113. Epub May 22, 2013.

Mojica et al., Intervening sequences of regularly spaced prokaryotic repeats derive from foreign genetic elements. J Mol Evol. Feb. 2005;60(2):174-82.

Mok et al., A bacterial cytidine deaminase toxin enables CRISPR-free mitochondrial base editing. Nature. Jul. 2020;583(7817):631-637. doi: 10.1038/s41586-020-2477-4. Epub Jul. 8, 2020.

Mol et al., Crystal structure and mutational analysis of human uracil-DNA glycosylase: structural basis for specificity and catalysis. Cell. Mar. 24, 1995;80(6):869-78. doi: 10.1016/0092-8674(95)90290-2.

Mol et al., Crystal structure of human uracil-DNA glycosylase in complex with a protein inhibitor: protein mimicry of DNA. Cell. Sep. 8, 1995;82(5):701-8.

Molla et al., CRISPR/Cas-Mediated Base Editing: Technical Considerations and Practical Applications. Trends Biotechnol. Oct. 2019;37(10):1121-1142. doi: 10.1016/j.tibtech.2019.03.008. Epub Apr. 14, 2019.

Monahan et al., Site-specific incorporation of unnatural amino acids into receptors expressed in Mammalian cells. Chem Biol. Jun. 2003;10(6):573-80.

Monot et al., The specificity and flexibility of l1 reverse transcription priming at imperfect T-tracts. PLoS Genet. May 2013;9(5):e1003499. doi: 10.1371/journal.pgen.1003499. Epub May 9, 2013.

Montange et al., Structure of the S-adenosylmethionine riboswitch regulatory mRNA element. Nature. Jun. 29, 2006;441(7097):1172-5.

Moore et al., Improved somatic mutagenesis in zebrafish using transcription activator-like effector nucleases (TALENs). PLoS One. 2012;7(5):e37877. Doi: 10.1371/journal.pone.0037877. Epub May 24, 2012.

(56) References Cited

OTHER PUBLICATIONS

Mootz et al., Conditional protein splicing: a new tool to control protein structure and function in vitro and in vivo. J Am Chem Soc. Sep. 3, 2003;125(35):10561-9.
Mootz et al., Protein splicing triggered by a small molecule. J Am Chem Soc. Aug. 7, 2002;124(31):9044-5.
Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.
Moreno-Mateos et al., CRISPRscan: designing highly efficient sgRNAs for CRISPR-Cas9 targeting in vivo. Nat Methods. Oct. 2015;12(10):982-8. doi: 10.1038/nmeth.3543. Epub Aug. 31, 2015.
Morita et al., The site-specific recombination system of actinophage TG1. FEMS Microbiol Lett. Aug. 2009;297(2):234-40. doi: 10.1111/j.1574-6968.2009.01683.x.
Morris et al., A peptide carrier for the delivery of biologically active proteins into mammalian cells. Nat Biotechnol. Dec. 2001;19(12):1173-6.
Moscou et al., A simple cipher governs DNA recognition by TAL effectors. Science. Dec. 11, 2009;326(5959):1501. doi: 10.1126/science.1178817.
Mougiakos et al., Characterizing a thermostable Cas9 for bacterial genome editing and silencing. Nat Commun. Nov. 21, 2017;8(1):1647. doi: 10.1038/s41467-017-01591-4.
Muir et al., Expressed protein ligation: a general method for protein engineering. Proc Natl Acad Sci U S A. Jun. 9, 1998;95(12):6705-10. doi: 10.1073/pnas.95.12.6705.
Muller et al., Nucleotide exchange and excision technology (NExT) DNA shuffling: a robust method for DNA fragmentation and directed evolution. Nucleic Acids Res. Aug. 1, 2005;33(13):e117. doi: 10.1093/nar/gni116. PMID: 16061932; PMCID: PMC1182171.
Muller, U.F., Design and Experimental Evolution of trans-Splicing Group I Intron Ribozymes. Molecules. Jan. 2, 2017;22(1):75. doi: 10.3390/molecules22010075.
Mullins et al., Transgenesis in nonmurine species. Hypertension. Oct. 1993;22(4):630-3.
Mumtsidu et al., Structural features of the single-stranded DNA-binding protein of Epstein-Barr virus. J Struct Biol. Feb. 2008;161(2):172-87. doi: 10.1016/j.jsb.2007.10.014. Epub Nov. 1, 2007.
Murphy, Phage recombinases and their applications. Adv Virus Res. 2012;83:367-414. doi: 10.1016/B978-0-12-394438-2.00008-6. Review.
Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.
Muzyczka et al., Adeno-associated virus (AAV) vectors: will they work? J Clin Invest. Oct. 1994;94(4):1351. doi: 10.1172/JCI117468.
Myerowitz et al., The major defect in Ashkenazi Jews with Tay-Sachs disease is an insertion in the gene for the alpha-chain of beta-hexosaminidase. J Biol Chem. Dec. 15, 1988;263(35):18587-9.
Myers et al., Insulin signal transduction and the IRS proteins. Annu Rev Pharmacol Toxicol. 1996;36:615-58. doi: 10.1146/annurev.pa.36.040196.003151.
Nabel et al., Direct gene transfer for immunotherapy and immunization. Trends Biotechnol. May 1993;11(5):211-5. doi: 10.1016/0167-7799(93)90117-R.
Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.
Nahvi et al., Coenzyme B12 riboswitches are widespread genetic control elements in prokaryotes. Nucleic Acids Res. Jan. 2, 2004;32(1):143-50.
Nakade et al., Microhomology-mediated end-joining-dependent integration of donor DNA in cells and animals using TALENs and CRISPR/Cas9. Nat Commun. Nov. 20, 2014;5:5560. doi: 10.1038/ncomms6560.
Nakamura et al., Codon usage tabulated from international DNA sequence databases: status for the year 2000. Nucleic Acids Res. Jan. 1, 2000;28(1):292. doi: 10.1093/nar/28.1.292.
Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.
Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.
Navaratnam et al., An overview of cytidine deaminases. Int J Hematol. Apr. 2006;83(3):195-200.
NCBI Reference Sequence: NM_002427.3. Wu et al., May 3, 2014. 5 pages.
Neel et al., Riboswitches: Classification, function and in silico approach, International Journal of Pharma Sciences and Research. 2010;1(9):409-420.
Nelson et al., Engineered pegRNAs improve prime editing efficiency. Nat Biotechnol. Oct. 4, 2021. doi: 10.1038/s41587-021-01039-7. Epub ahead of print. Erratum in: Nat Biotechnol. Dec. 8, 2021. 14 pages.
Nelson et al., Filamentous phage DNA cloning vectors: a noninfective mutant with a nonpolar deletion in gene III. Virology. 1981;108(2): 338-50.
Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.
Newby et al., Base editing of haematopoietic stem cells rescues sickle cell disease in mice. Nature. Jun. 2, 2021. doi: 10.1038/s41586-021-03609-w. Epub ahead of print.
Nguyen et al., Evolutionary drivers of thermoadaptation in enzyme catalysis. Science. Jan. 20, 2017;355(6322):289-294. doi: 10.1126/science.aah3717. Epub Dec. 22, 2016.
Nguyen et al., IQ-TREE: a fast and effective stochastic algorithm for estimating maximum-likelihood phylogenies. Mol Biol Evol. Jan. 2015;32(1):268-74. doi: 10.1093/molbev/msu300. Epub Nov. 3, 2014.
Ni et al., A PCSK9-binding antibody that structurally mimics the EGF(A) domain of LDL-receptor reduces LDL cholesterol in vivo. J Lipid Res. 2011;52:76-86.
Ni et al., Nucleic acid aptamers: clinical applications and promising new horizons. Curr Med Chem. 2011;18(27):4206-14. Review.
Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.
Nishikura, Functions and regulation of RNA editing by ADAR deaminases. Annu Rev Biochem. 2010;79:321-349. doi:10.1146/annurev-biochem-060208-105251.
Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.
Nishimasu et al., Crystal Structure of *Staphylococcus aureus* Cas9. Cell. Aug. 27, 2015;162(5):1113-26. doi: 10.1016/j.cell.2015.08.007.
Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.
Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.
Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.
Noris et al., A phenylalanine-55 to serine amino-acid substitution in the human glycoprotein IX leucine-rich repeat is associated with Bernard-Soulier syndrome. Br J Haematol. May 1997;97(2):312-20.

(56) References Cited

OTHER PUBLICATIONS

Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.

Nowak et al., Characterization of single-stranded DNA-binding proteins from the psychrophilic bacteria Desulfotalea psychrophila, Flavobacterium psychrophilum, Psychrobacter arcticus, Psychrobacter cryohalolentis, Psychromonas ingrahamii, Psychroflexus torquis, and Photobacterium profundum. BMC Microbiol. Apr. 14, 2014;14:91. doi: 10.1186/1471-2180-14-91.

Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.

Nowak et al., Structural analysis of monomeric retroviral reverse transcriptase in complex with an RNA/DNA hybrid. Nucleic Acids Res. Apr. 1, 2013;41(6):3874-87. doi: 10.1093/nar/gkt053. Epub Feb. 4, 2013.

Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.

Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.

O'Connell et al., Programmable RNA recognition and cleavage by CRISPR/Cas9. Nature. Dec. 11, 2014;516(7530):263-6. doi: 10.1038/nature13769. Epub Sep. 28, 2014.

O'Maille et al., Structure-based combinatorial protein engineering (SCOPE). J Mol Biol. Aug. 23, 2002;321(4):677-91.

Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.

Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.

Oakes et al., Protein engineering of Cas9 for enhanced function. Methods Enzymol. 2014;546:491-511.

Odsbu et al., Specific-terminal interactions of the *Escherichia coli* SeqA protein are required to form multimers that restrain negative supercoils and form foci. Genes Cells. Nov. 2005;10(11):1039-49.

Oeemig et al., Solution structure of DnaE intein from Nostoc punctiforme: structural basis for the design of a new split intein suitable for site-specific chemical modification. FEBS Lett. May 6, 2009;583(9):1451-6.

Offord, Advances in Genome Editing. The Scientist, Apr. 20, 2016. http://www.the-scientist.com/?articles.view/articleNo/45903/title/Advances-in-Genome-Editing/.

Oh et al., Positional cloning of a gene for Hermansky-Pudlak syndrome, a disorder of cytoplasmic organelles. Nat Genet. Nov. 1996;14(3):300-6. doi: 10.1038/ng1196-300.

Ohe et al., Purification and properties of xanthine dehydrogenase from Streptomyces cyanogenus. J Biochem. Jul. 1979;86(1):45-53.

Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.

Olorunniji et al., Purification and In Vitro Characterization of Zinc Finger Recombinases. Methods Mol Biol. 2017;1642:229-245. doi: 10.1007/978-1-4939-7169-5_15.

Olorunniji et al., Site-specific recombinases: molecular machines for the Genetic Revolution. Biochem J. Mar. 15, 2016;473(6):673-84. doi: 10.1042/BJ20151112.

Olorunniji et al., Synapsis and catalysis by activated Tn3 resolvase mutants. Nucleic Acids Res. Dec. 2008;36(22):7181-91. doi: 10.1093/nar/gkn885. Epub Nov. 10, 2008.

Orlando et al., Zinc-finger nuclease-driven targeted integration into mammalian genomes using donors with limited chromosomal homology. Nucleic Acids Res. Aug. 2010;38(15):e152. doi: 10.1093/nar/gkq512. Epub Jun. 8, 2010.

Orthwein et al., A mechanism for the suppression of homologous recombination in G1 cells. Nature. Dec. 17, 2015;528(7582):422-6. doi: 10.1038/nature 16142. Epub Dec. 9, 2015.

Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.

Osborn et al., Base Editor Correction of COL7A1 in Recessive Dystrophic Epidermolysis Bullosa Patient-Derived Fibroblasts and iPSCs. J Invest Dermatol. Feb. 2020;140(2):338-347.e5. doi: 10.1016/j.jid.2019.07.701. Epub Aug. 19, 2019.

Osborn et al., TALEN-based gene correction for epidermolysis bullosa. Mol Ther. Jun. 2013;21(6):1151-9. doi: 10.1038/mt.2013.56. Epub Apr. 2, 2013.

Ostermeier et al., A combinatorial approach to hybrid enzymes independent of DNA homology. Nat Biotechnol. Dec. 1999;17(12):1205-9.

Ostertag et al., Biology of mammalian L1 retrotransposons. Annu Rev Genet. 2001;35:501-38. doi: 10.1146/annurev.genet.35.102401.091032.

Otomo et al., Improved segmental isotope labeling of proteins and application to a larger protein. J Biomol NMR. Jun. 1999;14(2):105-14. doi: 10.1023/a:1008308128050.

Otomo et al., NMR observation of selected segments in a larger protein: central-segment isotope labeling through intein-mediated ligation. Biochemistry. Dec. 7, 1999;38(49):16040-4. doi: 10.1021/bi991902j.

Otto et al., The probability of fixation in populations of changing size. Genetics. Jun. 1997;146(2):723-33.

Packer et al., Methods for the directed evolution of proteins. Nat Rev Genet. Jul. 2015;16(7):379-94. doi: 10.1038/nrg3927. Epub Jun. 9, 2015.

Packer et al., Phage-assisted continuous evolution of proteases with altered substrate specificity. Nat Commun. Oct. 16, 2017;8(1):956. doi: 10.1038/s41467-017-01055-9.

Paige et al., RNA mimics of green fluorescent protein. Science. Jul. 29, 2011;333(6042):642-6. doi:10.1126/science.1207339.

Paiva et al., Targeted protein degradation: elements of PROTAC design. Curr Opin Chem Biol. Jun. 2019;50:111-119. doi: 10.1016/j.cbpa.2019.02.022. Epub Apr. 17, 2019.

Pan et al., Biological and biomedical applications of engineered nucleases. Mol Biotechnol. Sep. 2013;55(1):54-62. doi: 10.1007/s12033-012-9613-9.

Paquet et al., Efficient introduction of specific homozygous and heterozygous mutations using CRISPR/Cas9. Nature. May 5, 2016;533(7601):125-9. doi: 10.1038/nature17664. Epub Apr. 27, 2016.

Park et al., Digenome-seq web tool for profiling CRISPR specificity. Nat Methods. May 30, 2017;14(6):548-549. doi: 10.1038/nmeth.4262.

Park et al., Highly efficient editing of the ?-globin gene in patient-derived hematopoietic stem and progenitor cells to treat sickle cell disease. Nucleic Acids Res. Sep. 5, 2019;47(15):7955-7972. doi: 10.1093/nar/gkz475.

Park et al., Sendai virus, an RNA virus with no risk of genomic integration, delivers CRISPR/Cas9 for efficient gene editing. Mol Ther Methods Clin Dev. Aug. 24, 2016;3:16057. doi: 10.1038/mtm.2016.57.

Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.

Patel et al., Flap endonucleases pass 5'-flaps through a flexible arch using a disorder-thread-order mechanism to confer specificity for free 5'-ends. Nucleic Acids Res. May 2012;40(10):4507-19. doi: 10.1093/nar/gks051. Epub Feb. 8, 2012.

Pattanayak et al., Determining the specificities of TALENs, Cas9, and other genome-editing enzymes. Methods Enzymol. 2014;546:47-78. doi: 10.1016/B978-0-12-801185-0.00003-9.

Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.

(56) References Cited

OTHER PUBLICATIONS

Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Pawson et al., Protein phosphorylation in signaling—50 years and counting. Trends Biochem Sci. Jun. 2005;30(6):286-90. doi: 10.1016/j.tibs.2005.04.013.
Pearl, Structure and function in the uracil-DNA glycosylase superfamily. Mutat Res. Aug. 30, 2000;460(3-4):165-81.
Peck et al., Directed evolution of a small-molecule-triggered intein with improved splicing properties in mammalian cells. Chem Biol. May 27, 2011;18(5):619-30. doi: 10.1016/j.chembiol.2011.02.014.
Pellenz et al., New human chromosomal safe harbor sites for genome engineering with CRISPR/Cas9, TAL effector and homing endonucleases. Aug. 20, 2018. bioRxiv doi: https://doi.org/10.1101/396390.
Pelletier, CRISPR-Cas systems for the study of the immune function. Nov. 15, 2016. https://doi.org/10.1002/9780470015902.a0026896.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perach et al., Catalytic features of the recombinant reverse transcriptase of bovine leukemia virus expressed in bacteria. Virology. Jun. 20, 1999;259(1):176-89. doi: 10.1006/viro.1999.9761.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.
Perler et al., Protein splicing and autoproteolysis mechanisms. Curr Opin Chem Biol. Oct. 1997;1(3):292-9. doi: 10.1016/s1367-5931(97)80065-8.
Perler et al., Protein splicing elements: inteins and exteins—a definition of terms and recommended nomenclature. Nucleic Acids Res. Apr. 11, 1994;22(7):1125-7. doi: 10.1093/nar/22.7.1125.
Perler, InBase, the New England Biolabs Intein Database. Nucleic Acids Res. Jan. 1, 1999;27(1):346-7. doi: 10.1093/nar/27.1.346.
Perler, Protein splicing of inteins and hedgehog autoproteolysis: structure, function, and evolution. Cell. Jan. 9, 1998;92(1):1-4. doi: 10.1016/s0092-8674(00)80892-2.
Perreault et al., Mixed deoxyribo- and ribo-oligonucleotides with catalytic activity. Nature. Apr. 5, 1990;344(6266):565-7. doi: 10.1038/344565a0.
Petek et al., Frequent endonuclease cleavage at off-target locations in vivo. Mol Ther. May 2010;18(5):983-6. Doi: 10.1038/mt.2010.35. Epub Mar. 9, 2010.
Petersen-Mahrt et al., AID mutates *E. coli* suggesting a DNA deamination mechanism for antibody diversification. Nature. Jul. 4, 2002;418(6893):99-103.
Petolino et al., Editing Plant Genomes: a new era of crop improvement. Plant Biotechnol J. Feb. 2016;14(2):435-6. doi: 10.1111/pbi.12542.
Peyrottes et al., Oligodeoxynucleoside phosphoramidates (P-NH2): synthesis and thermal stability of duplexes with DNA and RNA targets. Nucleic Acids Res. May 15, 1996;24(10):1841-8.
Pfeiffer et al., Mechanisms of DNA double-strand break repair and their potential to induce chromosomal aberrations. Mutagenesis. Jul. 2000;15(4):289-302. doi: 10.1093/mutage/15.4.289.
Phillips, The challenge of gene therapy and DNA delivery. J Pharm Pharmacol. Sep. 2001;53(9):1169-74.

Pickart et al., Ubiquitin: structures, functions, mechanisms. Biochim Biophys Acta. Nov. 29, 2004;1695(1-3):55-72. doi: 10.1016/j.bbamcr.2004.09.019.
Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.
Pirakitikulr et al., PCRless library mutagenesis via oligonucleotide recombination in yeast. Protein Sci. Dec. 2010;19(12):2336-46. doi: 10.1002/pro.513.
Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.
Plosky et al., CRISPR-Mediated Base Editing without DNA Double-Strand Breaks. Mol Cell. May 19, 2016;62(4):477-8. doi: 10.1016/j.molcel.2016.05.006.
Pluciennik et al., PCNA function in the activation and strand direction of MutLα endonuclease in mismatch repair. Proc Natl Acad Sci U S A. Sep. 14, 2010;107(37):16066-71. doi: 10.1073/pnas.1010662107. Epub Aug. 16, 2010.
Poller et al., A leucine-to-proline substitution causes a defective alpha 1-antichymotrypsin allele associated with familial obstructive lung disease. Genomics. Sep. 1993;17(3):740-3.
Popp et al., Sortagging: a versatile method for protein labeling. Nat Chem Biol. Nov. 2007;3(11):707-8. doi: 10.1038/nchembio.2007.31. Epub Sep. 23, 2007.
Porteus, Design and testing of zinc finger nucleases for use in mammalian cells. Methods Mol Biol. 2008;435:47-61. doi: 10.1007/978-1-59745-232-8_4.
Posnick et al., Imbalanced base excision repair increases spontaneous mutation and alkylation sensitivity in *Escherichia coli*. J Bacteriol. Nov. 1999;181(21):6763-71.
Pospíšilová et al., Hydrolytic cleavage of N6-substituted adenine derivatives by eukaryotic adenine and adenosine deaminases. Biosci Rep. 2008;28(6):335-347. doi: 10.1042/BSR20080081.
Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.
Prasad et al., Rev1 is a base excision repair enzyme with 5'-deoxyribose phosphate lyase activity. Nucleic Acids Res. Dec. 15, 2016;44(22):10824-10833. doi: 10.1093/nar/gkw869. Epub Sep. 28, 2016.
Prashant et al., CAS9 transcriptional activators for target specificity screening and paired nickases for cooperative genome engineering. Nature Biotechnology 2013;31(9):833-8.
Prorocic et al., Zinc-finger recombinase activities in vitro. Nucleic Acids Res. Nov. 2011;39(21):9316-28. doi: 10.1093/nar/gkr652. Epub Aug. 17, 2011.
Proudfoot et al., Zinc finger recombinases with adaptable DNA sequence specificity. PLoS One. Apr. 29, 2011;6(4):e19537. doi: 10.1371/journal.pone.0019537.
Pruschy et al., Mechanistic studies of a signaling pathway activated by the organic dimerizer FK1012. Chem Biol. Nov. 1994;1(3):163-72. doi: 10.1016/1074-5521(94)90006-x.
Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.
Pu et al., Evolution of a split RNA polymerase as a versatile biosensor platform. Nat Chem Biol. Apr. 2017;13(4):432-438. doi: 10.1038/nchembio.2299. Epub Feb. 13, 2017.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Qi et al., Repurposing CRISPR as an RNA-guided platform for sequence-specific control of gene expression. Cell. Feb. 28, 2013;152(5):1173-83. doi: 10.1016/j.cell.2013.02.022.

(56) References Cited

OTHER PUBLICATIONS

Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.

Queen et al., Immunoglobulin gene transcription is activated by downstream sequence elements. Cell. Jul. 1983;33(3):741-8. doi: 10.1016/0092-8674(83)90016-8.

Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.

Raghavan et al., Abstract 27: Therapeutic Targeting of Human Lipid Genes with in vivo CRISPR-Cas9 Genome Editing. Oral Abstract Presentations: Lipoprotein Metabolism and Therapeutic Targets. Arterioscler THromb Vasc Biol. 2015;35(Suppl. 1):Abstract 27. 5 pages.

Raillard et al., Targeting sites within HIV-1 cDNA with a DNA-cleaving ribozyme. Biochemistry. Sep. 10, 1996;35(36):11693-701. doi: 10.1021/bi960845g.

Raina et al., PROTAC-induced BET protein degradation as a therapy for castration-resistant prostate cancer. Proc Natl Acad Sci U S A. Jun. 28, 2016;113(26):7124-9. doi: 10.1073/pnas.1521738113. Epub Jun. 6, 2016.

Rakonjac et al., Roles of PIII in filamentous phage assembly. J Mol Biol. 1998; 282(1)25-41.

Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.

Ramamurthy et al., Identification of immunogenic B-cell epitope peptides of rubella virus E1 glycoprotein towards development of highly specific immunoassays and/or vaccine. Conference Abstract. 2019.

Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.

Ramirez et al., Unexpected failure rates for modular assembly of engineered zinc fingers. Nat Methods. May 2008;5(5):374-5. Doi: 10.1038/nmeth0508-374.

Ran et al., Double Nicking by RNA-guided CRISPR Cas9 for Enhanced Genome Editing Specificity. Cell. Sep. 12, 2013;154(6):1380-9. doi: 10.1016/j.cell.2013.08.021. Epub Aug. 29, 2013.

Ran et al., Genome engineering using the CRISPR-Cas9 system. Nat Protoc. Nov. 2013;8(11):2281-308. doi: 10.1038/nprot.2013.143. Epub Oct. 24, 2013.

Ran et al., In vivo genome editing using *Staphylococcus aureus* Cas9. Nature. Apr. 9, 2015;520(7546):186-91. doi: 10.1038/nature14299. Epub Apr. 1, 2015.

Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem.8b00958. Epub Dec. 12, 2018.

Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.

Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.

Raskin et al., Substitution of a single bacteriophage T3 residue in bacteriophage T7 RNA polymerase at position 748 results in a switch in promoter specificity. J Mol Biol. Nov. 20, 1992;228(2):506-15.

Raskin et al., T7 RNA polymerase mutants with altered promoter specificities. Proc Natl Acad Sci U S A. Apr. 15, 1993;90(8):3147-51.

Rath et al., Fidelity of end joining in mammalian episomes and the impact of Metnase on joint processing. Bmc Mol Biol. Mar. 22, 2014;15:6. doi: 10.1186/1471-2199-15-6.

Rauch et al., Programmable RNA Binding Proteins for Imaging and Therapeutics. Biochemistry. Jan. 30, 2018;57(4):363-364. doi: 10.1021/acs.biochem.7b01101. Epub Nov. 17, 2017.

Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).

Ray et al., A compendium of RNA-binding motifs for decoding gene regulation. Nature. Jul. 11, 2013;499(7457):172-7. doi: 10.1038/nature12311.

Ray et al., Homologous recombination: ends as the means. Trends Plant Sci. Oct. 2002;7(10):435-40.

Rebar et al., Phage display methods for selecting zinc finger proteins with novel DNA-binding specificities. Methods Enzymol. 1996;267:129-49.

Rebuzzini et al., New mammalian cellular systems to study mutations introduced at the break site by non-homologous end-joining. DNA Repair (Amst). May 2, 2005;4(5):546-55.

Rees et al., Analysis and minimization of cellular RNA editing by DNA adenine base editors. Sci Adv. May 8, 2019;5(5):eaax5717. doi: 10.1126/sciadv.aax5717.

Rees et al., Base editing: precision chemistry on the genome and transcriptome of living cells. Nat Rev Genet. Dec. 2018;19(12):770-788. doi: 10.1038/s41576-018-0059-1.

Rees et al., Development of hRad51-Cas9 nickase fusions that mediate HDR without double-stranded breaks. Nat Commun. May 17, 2019;10(1):2212. doi: 10.1038/s41467-019-09983-4.

Rees et al., Improving the DNA specificity and applicability of base editing through protein engineering and protein delivery. Nat Commun. Jun. 6, 2017;8:15790. doi: 10.1038/ncomms15790.

Relph et al., Recent developments and current status of gene therapy using viral vectors in the United Kingdom. BMJ. 2004;329(7470):839-842. doi:10.1136/bmj.329.7470.839.

Remy et al., Gene transfer with a series of lipophilic DNA-binding molecules. Bioconjug Chem. Nov.-Dec. 1994;5(6):647-54. doi: 10.1021/bc00030a021.

Ren et al., In-line Alignment and $Mg^{2}$? Coordination at the Cleavage Site of the env22 Twister Ribozyme. Nat Commun. Nov. 20, 2014;5:5534. doi: 10.1038/ncomms6534.

Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.

Reynaud et al., What role for AID: mutator, or assembler of the immunoglobulin mutasome? Nat Immunol. Jul. 2003;4(7):631-8.

Reyon et al., FLASH assembly of TALENs for high-throughput genome editing. Nat Biotechnol. May 2012;30(5):460-5. doi: 10.1038/nbt.2170.

Ribeiro et al., Protein Engineering Strategies to Expand CRISPR-Cas9 Applications. Int J Genomics. Aug. 2, 2018;2018:1652567. doi: 10.1155/2018/1652567.

Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.

Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.

Richter et al., Phage-assisted evolution of an adenine base editor with improved Cas domain compatibility and activity. Nat Biotechnol. Jul. 2020;38(7):883-891. doi: 10.1038/s41587-020-0453-z. Epub Mar. 16, 2020.

Riechmann et al., The C-terminal domain of TolA is the coreceptor for filamentous phage infection of *E. coli*. Cell. 1997; 90(2):351-60. PMID:9244308.

Ringrose et al., The Kw recombinase, an integrase from Kluyveromyces waltii. Eur J Biochem. Sep. 15, 1997;248(3):903-12. doi: 10.1111/j.1432-1033.1997.00903.x.

(56) References Cited

OTHER PUBLICATIONS

Risso et al., Hyperstability and substrate promiscuity in laboratory resurrections of Precambrian ?-lactamases. J Am Chem Soc. Feb. 27, 2013;135(8):2899-902. doi: 10.1021/ja311630a. Epub Feb. 14, 2013.
Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.
Robertson et al., DNA repair in mammalian cells: Base excision repair: the long and short of it. Cell Mol Life Sci. Mar. 2009;66(6):981-93. doi: 10.1007/s00018-009-8736-z.
Robertson et al., Selection in vitro of an RNA enzyme that specifically cleaves single-stranded DNA. Nature. Mar. 29, 1990;344(6265):467-8. doi: 10.1038/344467a0.
Robinson et al., The protein tyrosine kinase family of the human genome. Oncogene. Nov. 20, 2000;19(49):5548-57. doi: 10.1038/sj.onc.1203957.
Rogozin et al., Evolution and diversification of lamprey antigen receptors: evidence for involvement of an AID-APOBEC family cytosine deaminase. Nat Immunol. Jun. 2007;8(6):647-56. doi: 10.1038/ni1463. Epub Apr. 29, 2007.
Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.
Rongrong et al., Effect of deletion mutation on the recombination activity of Cre recombinase. Acta Biochim Pol. 2005;52(2):541-4. Epub May 15, 2005.
Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.
Roth et al., Purification and characterization of murine retroviral reverse transcriptase expressed in *Escherichia coli*. J Biol Chem. Aug. 5, 1985;260(16):9326-35.
Rouet et al., Expression of a site-specific endonuclease stimulates homologous recombination in mammalian cells. Proc Natl Acad Sci U S A. Jun. 21, 1994;91(13):6064-8. doi: 10.1073/pnas.91.13.6064.
Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.
Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.
Roundtree et al., YTHDC1 mediates nuclear export of N6-methyladenosine methylated mRNAs. Elife. Oct. 6, 2017;6:e31311. doi: 10.7554/eLife.31311.
Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.
Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.
Rowley, Chromosome translocations: dangerous liaisons revisited. Nat Rev Cancer. Dec. 2001;1(3):245-50. doi: 10.1038/35106108.
Rubio et al., An adenosine-to-inosine tRNA-editing enzyme that can perform C-to-U deamination of DNA. Proc Natl Acad Sci U S A. May 8, 2007;104(19):7821-6. doi: 10.1073/pnas.0702394104. Epub May 1, 2007. PMID: 17483465; PMCID: PMC1876531.
Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.
Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.
Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.
Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.
Rüfer et al., Non-contact positions impose site selectivity on Cre recombinase. Nucleic Acids Res. Jul. 1, 2002;30(13):2764-71. doi: 10.1093/nar/gkf399.
Sadelain et al., Safe harbours for the integration of new DNA in the human genome. Nat Rev Cancer. Dec. 1, 2011;12(1):51-8. doi: 10.1038/nrc3179.
Sadowski, The Flp recombinase of the 2-microns plasmid of *Saccharomyces cerevisiae*. Prog Nucleic Acid Res Mol Biol. 1995;51:53-91.
Sage et al., Proliferation of functional hair cells in vivo in the absence of the retinoblastoma protein. Science. Feb. 18, 2005;307(5712):1114-8. Epub Jan. 13, 2005.
Saha et al., The NIH Somatic Cell Genome Editing program. Nature. Apr. 2021;592(7853):195-204. doi: 10.1038/s41586-021-03191-1. Epub Apr. 7, 2021.
Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.
Sale et al., Y-family DNA polymerases and their role in tolerance of cellular DNA damage. Nat Rev Mol Cell Biol. Feb. 23, 2012;13(3):141-52. doi: 10.1038/nrm3289.
Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.
Samal et al., Cationic polymers and their therapeutic potential. Chem Soc Rev. Nov. 7, 2012;41(21):7147-94. doi: 10.1039/c2cs35094g. Epub Aug. 10, 2012.
Samanta et al., A reverse transcriptase ribozyme. Elife. Sep. 26, 2017;6:e31153. doi: 10.7554/eLife.31153.
Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.
Sander et al., Targeted gene disruption in somatic zebrafish cells using engineered TALENs. Nat Biotechnol. Aug. 5, 2011;29(8):697-8. doi: 10.1038/nbt.1934.
Sang et al., A unique uracil-DNA binding protein of the uracil DNA glycosylase superfamily. Nucleic Acids Res. Sep. 30, 2015;43(17):8452-63. doi: 10.1093/nar/gkv854. Epub Aug. 24, 2015.
Sang, Prospects for transgenesis in the chick. Mech Dev. Sep. 2004;121(9):1179-86.
Sanjana et al., A transcription activator-like effector toolbox for genome engineering. Nat Protoc. Jan. 5, 2012;7(1):171-92. doi: 10.1038/nprot.2011.431.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.
Santoro et al., Directed evolution of the site specificity of Cre recombinase. Proc Natl Acad Sci U S A. Apr. 2, 2002;99(7):4185-90. Epub Mar. 19, 2002.
Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.
Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.

(56) References Cited

OTHER PUBLICATIONS

Sapunar et al., Dorsal root ganglion—a potential new therapeutic target for neuropathic pain. J Pain Res. 2012;5:31-8. doi: 10.2147/JPR.S26603. Epub Feb. 16, 2012.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sarkar et al., HIV-1 proviral DNA excision using an evolved recombinase. Science. Jun. 29, 2007;316(5833):1912-5. doi: 10.1126/science.1141453.
Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.
Sasidharan et al., The selection of acceptable protein mutations. PNAS; Jun. 12, 2007;104(24):10080-5. www.pnas.org/cgi/doi/10.1073.pnas.0703737104.
Satomura et al., Precise genome-wide base editing by the CRISPR Nickase system in yeast. Sci Rep. May 18, 2017;7(1):2095. doi: 10.1038/s41598-017-02013-7.
Saudek et al., A preliminary trial of the programmable implantable medication system for insulin delivery. Engl J Med. Aug. 31, 1989;321(9):574-9.
Sauer et al., DNA recombination with a heterospecific Cre homolog identified from comparison of the pac-cl regions of P1-related phages. Nucleic Acids Res. Nov. 18, 2004;32(20):6086-95. doi: 10.1093/nar/gkh941.
Savic et al., Covalent linkage of the DNA repair template to the CRISPR-Cas9 nuclease enhances homology-directed repair. Elife. May 29, 2018;7:e33761. doi: 10.7554/eLife.33761.
Saville et al., A site-specific self-cleavage reaction performed by a novel RNA in Neurospora mitochondria. Cell. May 18, 1990;61(4):685-96. doi: 10.1016/0092-8674(90)90480-3.
Savva et al., The structural basis of specific base-excision repair by uracil-DNA glycosylase. Nature. Feb. 9, 1995;373(6514):487-93. doi: 10.1038/373487a0.
Schaaper et al., Base selection, proofreading, and mismatch repair during DNA replication in *Escherichia coli*. J Biol Chem. Nov. 15, 1993;268(32):23762-5.
Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.
Schaefer et al., Understanding RNA modifications: the promises and technological bottlenecks of the 'epitranscriptome'. Open Biol. May 2017;7(5):170077. doi: 10.1098/rsob.170077.
Schechner et al., Multiplexable, locus-specific targeting of long RNAs with CRISPR-Display. Nat Methods. Jul. 2015;12(7):664-70. doi: 10.1038/nmeth.3433. Epub Jun. 1, 2015. Author manuscript entitled CRISPR Display: A modular method for locus-specific targeting of long noncoding RNAs and synthetic RNA devices in vivo.
Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.
Schenk et al., MPDU1 mutations underlie a novel human congenital disorder of glycosylation, designated type If. J Clin Invest. Dec. 2001;108(11):1687-95. doi: 10.1172/JCI13419.
Schmitz et al., Behavioral abnormalities in prion protein knockout mice and the potential relevance of PrP(C) for the cytoskeleton. Prion. 2014;8(6):381-6. doi: 10.4161/19336896.2014.983746.
Schriefer et al., Low pressure DNA shearing: a method for random DNA sequence analysis. Nucleic Acids Res. Dec. 25, 1990;18(24):7455-6.
Schultz et al., Expression and secretion in yeast of a 400-kDa envelope glycoprotein derived from Epstein-Barr virus. Gene. 1987;54(1):113-23. doi: 10.1016/0378-1119(87)90353-2.
Schultz et al., Oligo-2'-fluoro-2'-deoxynucleotide N3'→P5' phosphoramidates: synthesis and properties. Nucleic Acids Res. Aug. 1, 1996;24(15):2966-73.
Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwartz et al., Post-translational enzyme activation in an animal via optimized conditional protein splicing. Nat Chem Biol. Jan. 2007;3(1):50-4. Epub Nov. 26, 2006.
Schwarze et al., In vivo protein transduction: delivery of a biologically active protein into the mouse. Science. Sep. 3, 1999;285(5433):1569-72.
Schöller et al., Interactions, localization, and phosphorylation of the m6A generating METTL3-METTL14-WTAP complex. RNA. Apr. 2018;24(4):499-512. doi: 10.1261/rna.064063.117. Epub Jan. 18, 2018.
Sclimenti et al., Directed evolution of a recombinase for improved genomic integration at a native human sequence. Nucleic Acids Res. Dec. 15, 2001;29(24):5044-51.
Score Results for Luetticken et al., Complete genome sequence of a *Streptococcus dysgalactiae* subsp. RT equisimilis strain possessing Lancefield's group A antigen. RL Submitted to the EMBL/GenBank/DDBJ databases. May 2012. 3 pages.
Score Results for Okumura et al., Evolutionary paths of streptococcal and staphylococcal superantigens. RL BMC Genomics. 2012;13:404-404. 3 pages.
Score Results for Shimomura et al., Complete Genome Sequencing and Analysis of a Lancefield Group G RT *Streptococcus dysagalactiae* Subsp. Equisimilis Strain Causing Streptococcal RT Toxic Shock Syndrome (STSS). RL BMC Genomics. 2011;12:17-17. 3 pages.
Scott et al., Production of cyclic peptides and proteins in vivo. Proc Natl Acad Sci U S A. Nov. 23, 1999;96(24):13638-43. doi: 10.1073/pnas.96.24.13638.
Sebastían-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.
Seed, An LFA-3 cDNA encodes a phospholipid-linked membrane protein homologous to its receptor CD2. Nature. Oct. 29-Nov. 4, 1987;329(6142):840-2. doi: 10.1038/329840a0.
Sefton et al., Implantable pumps. Crit Rev Biomed Eng. 1987;14(3):201-40.
Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.
Sells et al., Delivery of protein into cells using polycationic liposomes. Biotechniques. Jul. 1995;19(1):72-6, 78.
Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Semple et al., Rational design of cationic lipids for siRNA delivery. Nat Biotechnol. Feb. 2010;28(2):172-6. doi: 10.1038/nbt.1602. Epub Jan. 17, 2010.
Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.
Serganov et al., Structural basis for discriminative regulation of gene expression by adenine- and guanine-sensing mRNAs. Chem Biol. Dec. 2004;11(12):1729-41.
Serganov et al., Structural basis for gene regulation by a thiamine pyrophosphate-sensing riboswitch. Nature. Jun. 29, 2006;441(7097):1167-71. Epub May 21, 2006.
Seripa et al., The missing ApoE allele. Ann Hum Genet. Jul. 2007;71(Pt 4):496-500. Epub Jan. 22, 2007.
Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.
Setten et al., The current state and future directions of RNAi-based therapeutics. Nat Rev Drug Discov. Jun. 2019;18(6):421-446. doi: 10.1038/s41573-019-0017-4.

(56) References Cited

OTHER PUBLICATIONS

Severinov et al., Expressed protein ligation, a novel method for studying protein-protein interactions in transcription. J Biol Chem. Jun. 26, 1998;273(26):16205-9. doi: 10.1074/jbc.273.26.16205.
Sha et al., Monobodies and other synthetic binding proteins for expanding protein science. Protein Sci. May 2017;26(5):910-924. doi: 10.1002/pro.3148. Epub Mar. 24, 2017.
Shah et al., Inteins: nature's gift to protein chemists. Chem Sci. 2014;5(1):446-461.
Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.
Shah et al., Protospacer recognition motifs: mixed identities and functional diversity. RNA Biol. May 2013;10(5):891-9. doi: 10.4161/rna.23764. Epub Feb. 12, 2013.
Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.
Shaikh et al., Chimeras of the Flp and Cre recombinases: tests of the mode of cleavage by Flp and Cre. J Mol Biol. Sep. 8, 2000;302(1):27-48.
Shalem et al., Genome-scale CRISPR-Cas9 knockout screening in human cells. Science. Jan. 3, 2014;343(6166):84-7. doi: 10.1126/science.1247005. Epub Dec. 12, 2013.
Shalem et al., High-throughput functional genomics using CRISPR-Cas9. Nat Rev Genet. May 2015;16(5):299-311. doi: 10.1038/nrg3899. Epub Apr. 9, 2015.
Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.
Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.
Sharma et al., Efficient introduction of aryl bromide functionality into proteins in vivo. FEBS Lett. Feb. 4, 2000;467(1):37-40.
Sharma et al., Identification of novel methyltransferases, Bmt5 and Bmt6, responsible for the m3U methylations of 25S rRNA in *Saccharomyces cerevisiae*. Nucleic Acids Res. Mar. 2014;42(5):3246-60. doi: 10.1093/nar/gkt1281. Epub Dec. 11, 2013.
Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 20, 2018.
Shaw et al., Implications of human genome architecture for rearrangement-based disorders: the genomic basis of disease. Hum Mol Genet. Apr. 1, 2004;13 Spec No. 1:R57-64. doi: 10.1093/hmg/ddh073. Epub Feb. 5, 2004.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Shechner et al., Multiplexable, locus-specific targeting of long RNAs with CRISPR-Display. Nat Methods. Jul. 2015;12(7):664-70. doi: 10.1038/nmeth.3433. Epub Jun. 1, 2015.
Shee et al., Engineered proteins detect spontaneous DNA breakage in human and bacterial cells. Elife. Oct. 29, 2013;2:e01222. doi: 10.7554/eLife.01222.
Shen et al., Herpes simplex virus 1 (HSV-1) for cancer treatment. Cancer Gene Ther. Nov. 2006;13(11):975-92. doi: 10.1038/sj.cgt.7700946. Epub Apr. 7, 2006.
Shen et al., Predictable and precise template-free CRISPR editing of pathogenic variants. Nature. Nov. 2018;563(7733):646-651. doi: 10.1038/s41586-018-0686-x. Epub Nov. 7, 2018.
Shen, Data processing, Modeling and Analysis scripts for CRISPR-inDelphi. GitHub—maxwshen/indelphi-dataprocessinganalysis at 6b68e3cec73c9358fef6e5f178a935f3c2a4118f. Apr. 10, 2018. Retrieved online via https://github.com/maxwshen/indelphi-sataprocessinganalysis/tree/6b68e3cec73c9358fef6e5f178a935f3c2a4118f Last retrieved on Jul. 26, 2021. 2 pages.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.
Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.
Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.
Shin et al., CRISPR/Cas9 targeting events cause complex deletions and insertions at 17 sites in the mouse genome. Nat Commun. May 31, 2017;8:15464. doi: 10.1038/ncomms15464.
Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.
Shingledecker et al., Molecular dissection of the *Mycobacterium tuberculosis* RecA intein: design of a minimal intein and of a trans-splicing system involving two intein fragments. Gene. Jan. 30, 1998;207(2):187-95. doi: 10.1016/s0378-1119(97)00624-0.
Shmakov et al., Discovery and Functional Characterization of Diverse Class 2 CRISPR Cas Systems. Molecular Cell Nov. 2015;60(3):385-97.
Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.
Shultz et al., A genome-wide analysis of FRT-like sequences in the human genome. PLoS One. Mar. 23, 2011;6(3):e18077. doi: 10.1371/journal.pone.0018077.
Siebert et al., An improved PCR method for walking in uncloned genomic DNA. Nucleic Acids Res. Mar. 25, 1995;23(6):1087-8.
Silas et al., Direct CRISPR spacer acquisition from RNA by a natural reverse transcriptase-Cas1 fusion protein. Science. Feb. 26, 2016;351(6276):aad4234. doi: 10.1126/science.aad4234.
Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.
Simonelli et al., Base excision repair intermediates are mutagenic in mammalian cells. Nucleic Acids Res. Aug. 2, 2005;33(14):4404-11. Print 2005.
Singh et al., Cross-talk between diverse serine integrases. J Mol Biol. Jan. 23, 2014;426(2):318-31. doi: 10.1016/j.jmb.2013.10.013. Epub Oct. 22, 2013.
Singh et al., Real-time observation of DNA recognition and rejection by the RNA-guided endonuclease Cas9. Nat Commun. Sep. 14, 2016;7:12778. doi: 10.1038/ncomms12778.
Singh et al., Real-time observation of DNA target interrogation and product release by the RNA-guided endonuclease CRISPR Cpf1 (Cas12a). Proc Natl Acad Sci U S A. May 22, 2018;115(21):5444-5449. doi: 10.1073/pnas.1718686115. Epub May 7, 2018.
Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.
Siu et al., Riboregulated toehold-gated gRNA for programmable CRISPR-Cas9 function. Nat Chem Biol. Mar. 2019;15(3):217-220. doi: 10.1038/s41589-018-0186-1. Epub Dec. 10, 2018.
Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.

(56) References Cited

OTHER PUBLICATIONS

Sjoblom et al., The consensus coding sequences of human breast and colorectal cancers. Science. Oct. 13, 2006;314(5797):268-74. Epub Sep. 7, 2006.

Skretas et al., Regulation of protein activity with small-molecule-controlled inteins. Protein Sci. Feb. 2005;14(2):523-32. Epub Jan. 4, 2005.

Slaymaker et al., Rationally engineered Cas9 nucleases with improved specificity. Science. Jan. 1, 2016;351(6268):84-8. doi: 10.1126/science.aad5227. Epub Dec. 1, 2015.

Sledz et al., Structural insights into the molecular mechanism of the m(6)A writer complex. Elife. Sep. 14, 2016;5:e18434. doi: 10.7554/eLife.18434.

Slupphaug et al., A nucleotide-flipping mechanism from the structure of human uracil-DNA glycosylase bound to DNA. Nature. Nov. 7, 1996;384(6604):87-92. doi: 10.1038/384087a0.

Smargon et al., Cas13b Is a Type VI-B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.

Smith et al., Diversity in the serine recombinases. Mol Microbiol. Apr. 2002;44(2):299-307. Review.

Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.

Smith et al., Herpesvirus transport to the nervous system and back again. Annu Rev Microbiol. 2012;66:153-76. doi: 10.1146/annurev-micro-092611-150051. Epub Jun. 15, 2012.

Smith et al., Production of human beta interferon in insect cells infected with a baculovirus expression vector. Mol Cell Biol. Dec. 1983;3(12):2156-65. doi: 10.1128/mcb.3.12.2156.

Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.

Smith, Filamentous fusion phage: novel expression vectors that display cloned antigens on the virion surface. Science. Jun. 14, 1985;228(4705):1315-7.

Smith, Phage-encoded Serine Integrases and Other Large Serine Recombinases. Microbiol Spectr. Aug. 2015;3(4). doi: 10.1128/microbiolspec.MDNA3-0059-2014.

Somanathan et al., AAV vectors expressing LDLR gain-of-function variants demonstrate increased efficacy in mouse models of familial hypercholesterolemia. Circ Res. Aug. 29, 2014;115(6):591-9. doi: 10.1161/CIRCRESAHA.115.304008. Epub Jul. 14, 2014.

Sommerfelt et al., Receptor interference groups of 20 retroviruses plating on human cells. Virology. May 1990;176(1):58-69. doi: 10.1016/0042-6822(90)90230-0.

Song et al., Adenine base editing in an adult mouse model of tyrosinaemia. Nat Biomed Eng. Jan. 2020;4(1):125-130. doi: 10.1038/s41551-019-0357-8. Epub Feb. 25, 2019.

Song et al., Delivery of CRISPR/Cas systems for cancer gene therapy and immunotherapy. Adv Drug Deliv Rev. Jan. 2021;168:158-180. doi: 10.1016/j.addr.2020.04.010. Epub May 1, 2020.

Southworth et al., Control of protein splicing by intein fragment reassembly. EMBO J. Feb. 16, 1998;17(4):918-26. doi: 10.1093/emboj/17.4.918.

Southworth et al., Purification of proteins fused to either the amino or carboxy terminus of the *Mycobacterium xenopi* gyrase A intein. Biotechniques. Jul. 1999;27(1):110-4, 116, 118-20. doi: 10.2144/99271st04.

Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.

Spencer et al., Controlling signal transduction with synthetic ligands. Science. Nov. 12, 1993;262(5136):1019-24. doi: 10.1126/science.7694365.

Spencer et al., Functional analysis of Fas signaling in vivo using synthetic inducers of dimerization. Curr Biol. Jul. 1, 1996;6(7):839-47. doi: 10.1016/s0960-9822(02)00607-3.

Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.

Stadtman, Selenocysteine. Annu Rev Biochem. 1996;65:83-100.

Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.

Steele et al., The prion protein knockout mouse: a phenotype under challenge. Prion. Apr.-Jun. 2007;1(2):83-93. doi: 10.4161/pri.1.2.4346. Epub Apr. 25, 2007.

Steiner et al., The neurotropic herpes viruses: herpes simplex and varicella-zoster. Lancet Neurol. Nov. 2007;6(11):1015-28. doi: 10.1016/S1474-4422(07)70267-3.

Stella et al., Structure of the Cpf1 endonuclease R-loop complex after target DNA cleavage. Nature. Jun. 22, 2017;546(7659):559-563. doi: 10.1038/nature22398. Epub May 31, 2017.

Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.

Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.

Stephens et al., The landscape of cancer genes and mutational processes in breast cancer. Nature Jun. 2012;486:400-404. doi: 10.1038/nature11017.

Sternberg et al., Conformational control of DNA target cleavage by CRISPR-Cas9. Nature. Nov. 5, 2015;527(7576):110-3. doi: 10.1038/nature15544. Epub Oct. 28, 2015.

Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.

Sterne-Weiler et al., Exon identity crisis: disease-causing mutations that disrupt the splicing code. Genome Biol. Jan. 23, 2014;15(1):201. doi: 10.1186/gb4150.

Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.

Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.

Stockwell et al., Probing the role of homomeric and heteromeric receptor interactions in TGF-beta signaling using small molecule dimerizers. Curr Biol. Jun. 18, 1998;8(13):761-70. doi: 10.1016/s0960-9822(98)70299-4.

Strecker et al., Engineering of CRISPR-Cas12b for human genome editing. Nat Commun. Jan. 22, 2019;10(1):212. doi: 10.1038/s41467-018-08224-4.

Strecker et al., RNA-guided DNA insertion with CRISPR-associated transposases. Science. Jul. 5, 2019;365(6448):48-53. doi: 10.1126/science.aax9181. Epub Jun. 6, 2019.

Strutt et al., RNA-dependent RNA targeting by CRISPR-Cas9. Elife. Jan. 5, 2018;7:e32724. doi: 10.7554/eLife.32724.

Su et al., Human DNA polymerase ? has reverse transcriptase activity in cellular environments. J Biol Chem. Apr. 12, 2019;294(15):6073-6081. doi: 10.1074/jbc.RA119.007925. Epub Mar. 6, 2019.

Sudarsan et al., An mRNA structure in bacteria that controls gene expression by binding lysine. Genes Dev. Nov. 1, 2003;17(21):2688-97.

Sudarsan et al., Riboswitches in eubacteria sense the second messenger cyclic di-GMP. Science. Jul. 18, 2008;321(5887):411-3. doi: 10.1126/science.1159519.

Suess et al., A theophylline responsive riboswitch based on helix slipping controls gene expression in vivo. Nucleic Acids Res. Mar. 5, 2004;32(4):1610-4.

(56) References Cited

OTHER PUBLICATIONS

Suh et al., Restoration of visual function in adult mice with an inherited retinal disease via adenine base editing. Nat Biomed Eng. Feb. 2021;5(2):169-178. doi: 10.1038/s41551-020-00632-6. Epub Oct. 19, 2020.
Sullenger et al., Ribozyme-mediated repair of defective mRNA by targeted, trans-splicing. Nature. Oct. 13, 1994;371(6498):619-22. doi: 10.1038/371619a0.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.
Sun et al., The CRISPR/Cas9 system for gene editing and its potential application in pain research. Transl Periop & Pain Med. Aug. 3, 2016;1(3):22-33.
Surun et al., High Efficiency Gene Correction in Hematopoietic Cells by Donor-Template-Free CRISPR/Cas9 Genome Editing. Mol Ther Nucleic Acids. Mar. 2, 2018;10:1-8. doi: 10.1016/j.omtn.2017.11.001. Epub Nov. 10, 2017.
Suzuki et al., Crystal structures reveal an elusive functional domain of pyrrolysyl-tRNA synthetase. Nat Chem Biol. Dec. 2017;13(12):1261-1266. doi: 10.1038/nchembio.2497. Epub Oct. 16, 2017.
Suzuki et al., In vivo genome editing via CRISPR/Cas9 mediated homology-independent targeted integration. Nature. Dec. 1, 2016;540(7631):144-149. doi: 10.1038/nature20565. Epub Nov. 16, 2016.
Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.
Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.
Tagalakis et al., Lack of RNA-DNA oligonucleotide (chimeraplast) mutagenic activity in mouse embryos. Mol Reprod Dev. Jun. 2005;71(2):140-4.
Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.
Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.
Takimoto et al., Stereochemical basis for engineered pyrrolysyl-tRNA synthetase and the efficient in vivo incorporation of structurally divergent non-native amino acids. ACS Chem Biol. Jul. 15, 2011;6(7):733-43. doi: 10.1021/cb200057a. Epub May 5, 2011.
Tambunan et al., Vaccine Design for H5N1 Based on B- and T-cell Epitope Predictions. Bioinform Biol Insights. Apr. 28, 2016;10:27-35. doi: 10.4137/BBI.S38378.
Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.
Tanese et al., Expression of enzymatically active reverse transcriptase in *Escherichia coli*. Proc Natl Acad Sci U S A. Aug. 1985;82(15):4944-8. doi: 10.1073/pnas.82.15.4944.
Tang et al., Aptazyme-embedded guide RNAs enable ligand-responsive genome editing and transcriptional activation. Nat Commun. Jun. 28, 2017;8:15939. doi: 10.1038/ncomms15939.
Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.
Tang et al., Rewritable multi-event analog recording in bacterial and mammalian cells. Science. Apr. 13, 2018;360(6385):eaap8992. doi: 10.1126/science.aap8992. Epub Feb. 15, 2018.
Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.
Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.
Tebas et al., Gene editing of CCR5 in autologous CD4 T cells of persons infected with HIV. Engl J Med. Mar. 6, 2014;370(10):901-10. doi: 10.1056/NEJMoa1300662.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Telenti et al., The *Mycobacterium xenopi* GyrA protein splicing element: characterization of a minimal intein. J Bacteriol. Oct. 1997;179(20):6378-82. doi: 10.1128/jb.179.20.6378-6382.1997.
Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.
Teng et al., Mutational analysis of apolipoprotein B mRNA editing enzyme (APOBEC1). structure-function relationships of RNA editing and dimerization. J Lipid Res. Apr. 1999;40(4):623-35.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12396962-0.00012-4.
Thomson et al., Mutational analysis of loxP sites for efficient Cre-mediated insertion into genomic DNA. Genesis. Jul. 2003;36(3):162-7. doi: 10.1002/gene.10211.
Thorpe et al., Functional correction of episomal mutations with short DNA fragments and RNA-DNA oligonucleotides. J Gene Med. Mar.-Apr. 2002;4(2):195-204.
Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.
Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.
Tirumalai et al., Recognition of core-type DNA sites by lambda integrase. J Mol Biol. Jun. 12, 1998;279(3):513-27.
Tom et al., Mechanism whereby proliferating cell nuclear antigen stimulates flap endonuclease 1. J Biol Chem. Apr. 7, 2000;275(14):10498-505. doi: 10.1074/jbc.275.14.10498.
Tone et al., Single-stranded DNA binding protein Gp5 of Bacillus subtilis phage ?29 is required for viral DNA replication in growth-temperature dependent fashion. Biosci Biotechnol Biochem. 2012;76(12):2351-3. doi: 10.1271/bbb.120587. Epub Dec. 7, 2012.

(56) References Cited

OTHER PUBLICATIONS

Toor et al., Crystal structure of a self-spliced group II intron. Science. Apr. 4, 2008;320(5872):77-82. doi: 10.1126/science.1153803.

Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb.2018.01317.

Toro et al., The Reverse Transcriptases Associated with CRISPR-Cas Systems. Sci Rep. Aug. 2, 2017;7(1):7089. doi: 10.1038/s41598-017-07828-y.

Torres et al., Non-integrative lentivirus drives high-frequency cre-mediated cassette exchange in human cells. PLoS One. 2011;6(5):e19794. doi: 10.1371/journal.pone.0019794. Epub May 23, 2011.

Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.

Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6.

Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.

Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.

Tratschin et al., Adeno-associated virus vector for high-frequency integration, expression, and rescue of genes in mammalian cells. Mol Cell Biol. Nov. 1985;5(11):3251-60. doi: 10.1128/mcb.5.11.3251.

Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.

Traxler et al., A genome-editing strategy to treat ?-hemoglobinopathies that recapitulates a mutation associated with a benign genetic condition. Nat Med. Sep. 2016;22(9):987-90. doi: 10.1038/nm.4170. Epub Aug. 15, 2016.

Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.

Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.

Tsai et al., Circle-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.

Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.

Tsai et al., Guide-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.

Tsang et al., Specialization of the DNA-cleaving activity of a group I ribozyme through in vitro evolution. J Mol Biol. Sep. 13, 1996;262(1):31-42. doi: 10.1006/jmbi.1996.0496.

Tsutakawa et al., Human flap endonuclease structures, DNA double-base flipping, and a unified understanding of the FEN1 superfamily. Cell. Apr. 15, 2011;145(2):198-211. doi: 10.1016/j.cell.2011.03.004.

Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.

Turan et al., Recombinase-mediated cassette exchange (RMCE): traditional concepts and current challenges. J Mol Biol. Mar. 25, 2015;407(2):193-221. doi: 10.1016/j.jmb.2011.01.004. Epub Jan. 15, 2011.

Turan et al., Site-specific recombinases: from tag-and-target- to tag-and-exchange-based genomic modifications. Faseb J. Dec. 2011;25(12):4088-107. doi: 10.1096/fj.11-186940. Epub Sep. 2, 2011. Review.

Tycko et al., Pairwise library screen systematically interrogates *Staphylococcus aureus* Cas9 specificity in human cells. bioRxiv. doi: https://doi.org/10.1101/269399 Posted Feb. 22, 2018.

UniProt Consortium, UniProt: the universal protein knowledgebase. Nucleic Acids Res. Mar. 16, 2018;46(5):2699. doi: 10.1093/nar/gky092.

UniProt Submission; UniProt, Accession No. P01011. Last modified Jun. 11, 2014, version 2. 15 pages.

UniProt Submission; UniProt, Accession No. P01011. Last modified Sep. 18, 2013, version 2. 15 pages.

UniProt Submission; UniProt, Accession No. P04264. Last modified Jun. 11, 2014, version 6. 15 pages.

UniProt Submission; UniProt, Accession No. P04275. Last modified Jul. 9, 2014, version 107. 29 pages.

UniProtein A0A1V6. Dec. 11, 2019.

UniProtkb Submission; Accession No. F0NH53. May 3, 2011. 4 pages.

UniProtkb Submission; Accession No. F0NN87. May 3, 2011. 4 pages.

UniProtkb Submission; Accession No. G3ECR1.2. No Author Listed., Aug. 12, 2020, 8 pages.

UniProtkb Submission; Accession No. P04264. No Author Listed., Apr. 7, 2021. 12 pages.

UniProtkb Submission; Accession No. P0DOC6. No Author Listed., Oct. 5, 2016. 5 pages.

UniProtkb Submission; Accession No. T0D7A2. Oct. 16, 2013. 10 pages.

UniProtkb Submission; Accession No. U2UMQ6. No Author Listed., Apr. 7, 2021, 11 pages.

Urasaki et al., Functional dissection of the Tol2 transposable element identified the minimal cis-sequence and a highly repetitive sequence in the subterminal region essential for transposition. Genetics. Oct. 2006;174(2):639-49. doi: 10.1534/genetics.106.060244. Epub Sep. 7, 2006.

Urnov et al., Genome editing with engineered zinc finger nucleases. Nat Rev Genet. Sep. 2010;11(9):636-46. doi: 10.1038/nrg2842.

Urnov et al., Highly efficient endogenous human gene correction using designed zinc-finger nucleases. Nature. Jun. 2, 2005;435(7042):646-51. Epub Apr. 3, 2005.

Usman et al., Exploiting the chemical synthesis of RNA. Trends Biochem Sci. Sep. 1992;17(9):334-9. doi: 10.1016/0968-0004(92)90306-t.

Vagner et al., Efficiency of homologous DNA recombination varies along the Bacillus subtilis chromosome. J Bacteriol. Sep. 1988;170(9):3978-82.

Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.

Van Brunt et al., Molecular Farming: Transgenic Animals as Bioreactors. Biotechnology (Y). 1988;6(10):1149-1154. doi: 10.1038/nbt1088-1149.

Van Duyne et al., Teaching Cre to follow directions. Proc Natl Acad Sci U S A. Jan. 6, 2009;106(1):4-5. doi: 10.1073/pnas.0811624106. Epub Dec. 31, 2008.

Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.

Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.

Van Wijk et al., Identification of 51 novel exons of the Usher syndrome type 2A (USH2A) gene that encode multiple conserved

(56) References Cited

OTHER PUBLICATIONS functional domains and that are mutated in patients with Usher syndrome type II. Am J Hum Genet. Apr. 2004;74(4):738-44. doi: 10.1086/383096. Epub Mar. 10, 2004.
Vanamee et al., FokI requires two specific DNA sites for cleavage. J Mol Biol. May 25, 2001;309(1):69-78.
Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600012103. Epub Feb. 21, 2006.
Vellore et al., A group II intron-type open reading frame from the thermophile Bacillus (Geobacillus) stearothermophilus encodes a heat-stable reverse transcriptase. Appl Environ Microbiol. Dec. 2004;70(12):7140-7. doi: 10.1128/AEM.70.12.7140-7147.2004.
Venken et al., Genome-wide manipulations of *Drosophila melanogaster* with transposons, Flp recombinase, and ΦC31 integrase. Methods Mol Biol. 2012;859:203-28. doi: 10.1007/978-1-61779-603-6_12.
Verma, The reverse transcriptase. Biochim Biophys Acta. Mar. 21, 1977;473(1):1-38. doi: 10.1016/0304-419x(77)90005-1.
Vigne et al., Third-generation adenovectors for gene therapy. Restor Neurol Neurosci. Jan. 1, 1995;8(1):35-6. doi: 10.3233/RNN-1995-81208.
Vik et al., Endonuclease V cleaves at inosines in RNA. Nat Commun. 2013;4:2271. doi: 10.1038/ncomms3271.
Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.
Villiger et al., Treatment of a metabolic liver disease by in vivo genome base editing in adult mice. Nat Med. Oct. 2018;24(10):1519-1525. doi: 10.1038/s41591-018-0209-1. Epub Oct. 8, 2018.
Vitreschak et al., Regulation of the vitamin B12 metabolism and transport in bacteria by a conserved RNA structural element. RNA. Sep. 2003;9(9):1084-97.
Voigt et al., Rational evolutionary design: the theory of in vitro protein evolution. Adv Protein Chem. 2000;55:79-160.
Vriend et al., Nick-initiated homologous recombination: Protecting the genome, one strand at a time. DNA Repair (Amst). Feb. 2017;50:1-13. doi: 10.1016/j.dnarep.2016.12.005. Epub Dec. 29, 2016.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wals et al., Unnatural amino acid incorporation in *E. coli*: current and future applications in the design of therapeutic proteins. Front Chem. Apr. 1, 2014;2:15. doi: 10.3389/fchem.2014.00015. eCollection 2014.
Wan et al., Material solutions for delivery of CRISPR/Cas-based genome editing tools: Current status and future outlook. Materials Today. Jun. 2019;26:40-66. doi: 10.1016/j.mattod.2018.12.003.
Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.
Wang et al., Continuous directed evolutions of proteins with improved soluble expression. Nature Chemical Biology. Nat Publishing Group. Aug. 20, 2018; 14(10):972-980.

Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Expanding the genetic code. Annu Rev Biophys Biomol Struct. 2006;35:225-49. Review.
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., Highly efficient CRISPR/HDR-mediated knock-in for mouse embryonic stem cells and zygotes. Biotechniques. 2015:59,201-2;204;206-8.
Wang et al., (6)-methyladenosine Modulates Messenger RNA Translation Efficiency. Cell. Jun. 4, 2015;161(6):1388-99. doi: 10.1016/j.cell.2015.05.014.
Wang et al., N6-methyladenosine-dependent regulation of messenger RNA stability. Nature. Jan. 2, 2014;505(7481):117-20. doi: 10.1038/nature12730. Epub Nov. 27, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Optimized paired-sgRNA/Cas9 cloning and expression cassette triggers high-efficiency multiplex genome editing in kiwifruit. Plant Biotechnol J. Aug. 2018;16(8):1424-1433. doi: 10.1111/pbi.12884. Epub Feb. 6, 2018.
Wang et al., Programming cells by multiplex genome engineering and accelerated evolution. Nature. Aug. 13, 2009;460(7257):894-8. Epub Jul. 26, 2009.
Wang et al., Reading RNA methylation codes through methyl-specific binding proteins. RNA Biol. 2014;11(6):669-72. doi: 10.4161/rna.28829. Epub Apr. 24, 2014.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., *Staphylococcus aureus* protein SAUGI acts as a uracil-DNA glycosylase inhibitor. Nucleic Acids Res. Jan. 2014;42(2):1354-64. doi: 10.1093/nar/gkt964. Epub Oct. 22, 2013.
Wang et al., Structural basis of (6)-adenosine methylation by the METTL3-METTL14 complex. Nature. Jun. 23, 2016;534(7608):575-8. doi: 10.1038/nature18298. Epub May 25, 2016.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci USA. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Watowich, The erythropoietin receptor: molecular structure and hematopoietic signaling pathways. J Investig Med. Oct. 2011;59(7):1067-72. doi: 10.2310/JIM.0b013e31820fb28c.

(56) References Cited

OTHER PUBLICATIONS

Waxman et al., Regulating excitability of peripheral afferents: emerging ion channel targets. Nat Neurosci. Feb. 2014;17(2):153-63. doi: 10.1038/nn.3602. Epub Jan. 28, 2014.
Weber et al., Assembly of designer TAL effectors by Golden Gate cloning. PLoS One. 2011;6(5):e19722. doi: 10.1371/journal.pone. 0019722. Epub May 19, 2011.
Weill et al., DNA polymerases in adaptive immunity. Nat Rev Immunol. Apr. 2008;8(4):302-12. doi: 10.1038/nri2281. Epub Mar. 14, 2008.
Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.
Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.
Weinberger et al., Disease-causing mutations C277R and C277Y modify gating of human ClC-1 chloride channels in myotonia congenita. J Physiol. Aug. 1, 2012;590(Pt 15):3449-64. doi: 0.1113/jphysiol.2012.232785. Epub May 28, 2012.
Weinert et al., Unbiased detection of CRISPR off-targets in vivo using Discover-Seq. Science. Apr. 19, 2019;364(6437):286-289. doi: 10.1126/science.aav9023. Epub Apr. 18, 2019.
Weiss et al., Loss-of-function mutations in sodium channel Nav1.7 cause anosmia. Nature. Apr. 14, 2011;472(7342):186-90. doi: 10.1038/nature09975. Epub Mar. 23, 2011.
Wen et al., Inclusion of a universal tetanus toxoid CD4(+) T cell epitope P2 significantly enhanced the immunogenicity of recombinant rotavirus ?VP8* subunit parenteral vaccines. Vaccine. Jul. 31, 2014;32(35):4420-4427. doi: 10.1016/j.vaccine.2014.06.060. Epub Jun. 21, 2014.
West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.
Wharton et al., A new-specificity mutant of 434 repressor that defines an amino acid-base pair contact. Nature. Apr. 30-May 6, 1987;326(6116):888-91.
Wharton et al., Changing the binding specificity of a repressor by redesigning an alpha-helix. Nature. Aug. 15-21, 1985;316(6029):601-5.
Wheeler et al., The thermostability and specificity of ancient proteins. Curr Opin Struct Biol. Jun. 2016;38:37-43. doi: 10.1016/j.sbi.2016.05.015. Epub Jun. 9, 2016.
Wiedenheft et al., RNA-guided genetic silencing systems in bacteria and archaea. Nature. Feb. 15, 2012;482(7385):331-8. doi: 10.1038/nature10886. Review.
Wienert et al., KLF1 drives the expression of fetal hemoglobin in British HPFH. Blood. Aug. 10, 2017;130(6):803-807. doi: 10.1182/blood-2017-02-767400. Epub Jun. 28, 2017.
Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.
Wilson et al., Assessing annotation transfer for genomics: quantifying the relations between protein sequence, structure and function through traditional and probabilistic scores. J Mol Biol 2000;297:233-49.
Wilson et al., Formation of infectious hybrid virions with gibbon ape leukemia virus and human T-cell leukemia virus retroviral envelope glycoproteins and the gag and pol proteins of Moloney murine leukemia virus. J Virol. May 1989;63(5):2374-8. doi: 10.1128/JVI.63.5.2374-2378.1989.
Wilson et al., In Vitro Selection of Functional Nucleic Acids. Annu Rev Biochem. 1999;68:611-47. doi: 10.1146/annurev.biochem.68.1.611.
Wilson et al., Kinase dynamics. Using ancient protein kinases to unravel a modern cancer drug's mechanism. Science. Feb. 20, 2015;347(6224):882-6. doi: 10.1126/science.aaa1823.
Wilson et al., Programmable m6A modification of cellular RNAs with a Cas13-directed methyltransferase. Nat Biotechnol. Dec. 2020;38(12):1431-1440. doi: 10.1038/s41587-020-0572-6. Epub Jun. 29, 2020.
Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Winoto et al., A novel, inducible and T cell-specific enhancer located at the 3' end of the T cell receptor alpha locus. EMBO J. Mar. 1989;8(3):729-33.
Winter et al., Drug Development. Phthalimide conjugation as a strategy for in vivo target protein degradation. Science. Jun. 19, 2015;348(6241):1376-81. doi:; 10.1126/science.aab1433. Epub May 21, 2015.
Winter et al., Targeted exon skipping with AAV-mediated split adenine base editors. Cell Discov. Aug. 20, 2019;5:41. doi: 10.1038/s41421-019-0109-7.
Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1.61.
Wolf et al., tadA, an essential tRNA-specific adenosine deaminase from *Escherichia coli*. EMBO J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wong et al., A statistical analysis of random mutagenesis methods used for directed protein evolution. J Mol Biol. Jan. 27, 2006;355(4):858-71. Epub Nov. 17, 2005.
Wong et al., The Diversity Challenge in Directed Protein Evolution. Comb Chem High Throughput Screen. May 2006;9(4):271-88.
Wood et al., A genetic system yields self-cleaving inteins for bioseparations. Nat Biotechnol. Sep. 1999;17(9):889-92. doi: 10.1038/12879.
Wood et al., Targeted genome editing across species using ZFNs and TALENs. Science. Jul. 15, 2011;333(6040):307. doi: 10.1126/science.1207773. Epub Jun. 23, 2011.
Woods et al., The phenotype of congenital insensitivity to pain due to the NaV1.9 variant p.L811P. Eur J Hum Genet. May 2015;23(5):561-3. doi: 10.1038/ejhg.2014.166. Epub Aug. 13, 2014.
Wright et al., Continuous in vitro evolution of catalytic function. Science. Apr. 25, 1997;276(5312):614-7.
Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.
Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.
Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.

(56) References Cited

OTHER PUBLICATIONS

Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.

Xiang et al., RNA m6A methylation regulates the ultraviolet-induced DNA damage response. Nature. Mar. 23, 2017;543(7646):573-576. doi: 10.1038/nature21671. Epub Mar. 15, 2017.

Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.

Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.

Xie et al., Adjusting the attB site in donor plasmid improves the efficiency of ?C31 integrase system. DNA Cell Biol. Jul. 2012;31(7):1335-40. doi: 10.1089/dna.2011.1590. Epub Apr. 10, 2012.

Xiong et al., Origin and evolution of retroelements based upon their reverse transcriptase sequences. EMBO J. Oct. 1990;9(10):3353-62.

Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.

Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas.96.2.388.

Xu et al., Multiplex nucleotide editing by high-fidelity Cas9 variants with improved efficiency in rice. BMC Plant Biol. 2019;19(1):511. Published Nov. 21, 2019. doi: 10.1186/s12870-019-2131-1. Includes supplementary data and materials.

Xu et al., Protein splicing: an analysis of the branched intermediate and its resolution by succinimide formation. EMBO J. Dec. 1, 1994;13(23):5517-22.

Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.

Xu et al., Sequence determinants of improved CRISPR sgRNA design. Genome Res. Aug. 2015;25(8):1147-57. doi: 10.1101/gr.191452.115. Epub Jun. 10, 2015.

Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.

Xu et al., The mechanism of protein splicing and its modulation by mutation. EMBO J. Oct. 1, 1996;15(19):5146-53.

Yahata et al., Unified, Efficient, and Scalable Synthesis of Halichondrins: Zirconium/Nickel- Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.

Yamada et al., Crystal Structure of the Minimal Cas9 from Campylobacter jejuni Reveals the Molecular Diversity in the CRISPR-Cas9 Systems. Mol Cell. Mar. 16, 2017;65(6):P1109-1121. /doi.org/10.1016/j.molcel.2017.02.007.

Yamamoto et al., The ons and offs of inducible transgenic technology: a review. Neurobiol Dis. Dec. 2001;8(6):923-32.

Yamamoto et al., Virological and immunological bases for HIV-1 vaccine design. Uirusu 2007;57(2):133-139. https://doi.org/10.2222/jsv.57.133.

Yamano et al., Crystal Structure of Cpf1 in Complex with Guide RNA and Target DNA. Cell May 2016;165(4)949-62.

Yamano et al., Crystal Structure of Cpf1 in Complex with Guide RNA and Target DNA. Cell. May 5, 2016;165(4):949-62 and Supplemental Info. doi: 10.1016/j.cell.2016.04.003. Epub Apr. 21, 2016.

Yamano et al., Crystal Structure of Cpf1 in Complex with Guide RNA and Target DNA. Cell. May 5, 2016;165(4):949-62. doi: 10.1016/j.cell.2016.04.003. Epub Apr. 21, 2016.

Yamazaki et al., Segmental Isotope Labeling for Protein NMR Using Peptide Splicing. J. Am. Chem. Soc. May 22, 1998; 120(22):5591-2. https://doi.org/10.1021/ja9807760.

Yan et al., Cas13d Is a Compact RNA-Targeting Type VI CRISPR Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.

Yan et al., Functionally diverse type V CRISPR-Cas systems. Science. Jan. 4, 2019;363(6422):88-91. doi: 10.1126/science.aav7271. Epub Dec. 6, 2018.

Yan et al., Highly Efficient A·T to G·C Base Editing by Cas9n-Guided tRNA Adenosine Deaminase in Rice. Mol Plant. Apr. 2, 2018;11(4):631-634. doi: 10.1016/j.molp.2018.02.008. Epub Feb. 22, 2018.

Yang et al., APOBEC: From mutator to editor. J Genet Genomics. Sep. 20, 2017;44(9):423-437. doi: 10.1016/j.jgg.2017.04.009. Epub Aug. 7, 2017.

Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.

Yang et al., Engineering and optimising deaminase fusions for genome editing. Nat Commun. Nov. 2, 2016;7:13330. doi: 10.1038/ncomms13330.

Yang et al., Genome editing with targeted deaminases. BioRxiv. Preprint. First posted online Jul. 28, 2016.

Yang et al., Increasing targeting scope of adenosine base editors in mouse and rat embryos through fusion of TadA deaminase with Cas9 variants. Protein Cell. Sep. 2018;9(9):814-819. doi: 10.1007/s13238-018-0568-x.

Yang et al., Mutations in SCN9A, encoding a sodium channel alpha subunit, in patients with primary erythermalgia. J Med Genet. Mar. 2004;41(3):171-4. doi: 10.1136/jmg.2003.012153.

Yang et al., New CRISPR-Cas systems discovered. Cell Res. Mar. 2017;27(3):313-314. doi: 10.1038/cr.2017.21. Epub Feb. 21, 2017.

Yang et al., One Prime for All Editing. Cell. Dec. 12, 2019;179(7):1448-1450. doi: 10.1016/j.cell.2019.11.030.

Yang et al., One-step generation of mice carrying reporter and conditional alleles by CRISPR/Cas-mediated genome engineering. Cell. Sep. 12, 2013;154(6):1370-9. doi: 10.1016/j.cell.2013.08.022. Epub Aug. 29, 2013.

Yang et al., PAM-dependent Target DNA Recognition and Cleavage by C2C1 CRISPR-Cas endonuclease. Cell Dec. 2016;167(7):1814-28.

Yang et al., Permanent genetic memory with >1-byte capacity. Nat Methods. Dec. 2014;11(12):1261-6. doi: 10.1038/nmeth.3147. Epub Oct. 26, 2014.

Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.

Yang et al., Small-molecule control of insulin and PDGF receptor signaling and the role of membrane attachment. Curr Biol. Jan. 1, 1998;8(1):11-8. doi: 10.1016/s0960-9822(98)70015-6.

Yang, Development of Human Genome Editing Tools for the Study of Genetic Variations and Gene Therapies. Doctoral Dissertation. Harvard University. 2013. Accessible via nrs.harvard.edu/urn-3:HUL.InstRepos:11181072. 277 pages.

Yang, Nucleases: diversity of structure, function and mechanism. Q Rev Biophys. Feb. 2011;44(1):1-93. doi: 10.1017/S0033583510000181. Epub Sep. 21, 2010.

Yang, PAML 4: phylogenetic analysis by maximum likelihood. Mol Biol Evol. Aug. 2007;24(8):1586-91. doi: 10.1093/molbev/msm088. Epub May 4, 2007.

Yang, Phylogenetic Analysis by Maximum Likelihood (PAML). //abacus.gene.ucl.ac.uk/software/paml.html Last accessed Apr. 28, 2021.

(56) References Cited

OTHER PUBLICATIONS

Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.
Yasui, Alternative excision repair pathways. Cold Spring Harb Perspect Biol. Jun. 1, 2013;5(6):a012617. doi: 10.1101/cshperspect.a012617.
Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.
Yazaki et al., Hereditary systemic amyloidosis associated with a new apolipoprotein AII stop codon mutation Stop78Arg. Kidney Int. Jul. 2003;64(1):11-6.
Yeh et al., In vivo base editing of post-mitotic sensory cells. Nat Commun. Jun. 5, 2018;9(1):2184. doi: 10.1038/s41467-018-04580-3.
Yeh et al., In vivo base editing restores sensory transduction and transiently improves auditory function in a mouse model of recessive deafness. Sci Transl Med. Jun. 3, 2020;12(546):eaay9101. doi: 10.1126/scitranslmed.aay9101.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yokoe et al., Spatial dynamics of GFP-tagged proteins investigated by local fluorescence enhancement. Nat Biotechnol. Oct. 1996;14(10):1252-6. doi: 10.1038/nbt1096-1252.
Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.
Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.
Yu et al., Liposome-mediated in vivo E1A gene transfer suppressed dissemination of ovarian cancer cells that overexpress HER-2/neu. Oncogene. Oct. 5, 1995;11(7):1383-8.
Yu et al., Progress towards gene therapy for HIV infection. Gene Ther. Jan. 1994;1(1):13-26.
Yu et al., Small molecules enhance CRISPR genome editing in pluripotent stem cells. Cell Stem Cell. Feb. 5, 2015;16(2):142-7. doi: 10.1016/j.stem.2015.01.003.
Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.
Yuan et al., Laboratory-directed protein evolution. Microbiol Mol Biol Rev. 2005; 69(3):373-92. PMID: 16148303.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.
Zalatan et al., Engineering complex synthetic transcriptional programs with CRISPR RNA scaffolds. Cell. Jan. 15, 2015;160(1-2):339-50. doi: 10.1016/j.cell.2014.11.052. Epub Dec. 18, 2014.
Zelphati et al., Intracellular delivery of proteins with a new lipid-mediated delivery system. J Biol Chem. Sep. 14, 2001;276(37):35103-10. Epub Jul. 10, 2001.
Zeng et al., Correction of the Marfan Syndrome Pathogenic FBN1 Mutation by Base Editing in Human Cells and Heterozygous Embryos. Mol Ther. Nov. 7, 2018;26(11):2631-2637. doi: 10.1016/j.ymthe.2018.08.007. Epub Aug. 14, 2018.
Zetsche et al., A split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71 and Supplemental Info. doi: 10.1016/j.cell.2015.09.038. Epub Sep. 25, 2015.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02.003. Epub Feb. 10, 2009.
Zhang et al., II-Clamp-mediated cysteine conjugation. Nat Chem. Feb. 2016;8(2):120-8. doi: 10.1038/nchem.2413. Epub Dec. 21, 2015.
Zhang et al., A new strategy for the site-specific modification of proteins in vivo. Biochemistry. Jun. 10, 2003;42(22):6735-46.
Zhang et al., Circular intronic long noncoding RNAs. Mol Cell. Sep. 26, 2013;51(6):792-806. doi: 10.1016/j.molcel.2013.08.017. Epub Sep. 12, 2013.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., Copy number variation in human health, disease, and evolution. Annu Rev Genomics Hum Genet. 2009;10:451-81. doi: 10.1146/annurev.genom.9.081307.164217.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.
Zhang et al., Global analysis of small RNA and mRNA targets of Hfq. Mol Microbiol. Nov. 2003;50(4):1111-24. doi: 10.1046/j.1365-2958.2003.03734.x.
Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.
Zhang et al., Programmable base editing of zebrafish genome using a modified CRISPR-Cas9 system. Nat Commun. Jul. 25, 2017;8(1):118. doi: 10.1038/s41467-017-00175-6.
Zhang et al., Reversible RNA Modification N1-methyladenosine (m1A) in mRNA and tRNA. Genomics Proteomics Bioinformatics. Jun. 2018;16(3):155-161. doi: 10.1016/j.gpb.2018.03.003. Epub Jun. 14, 2018.
Zhang et al., Ribozymes and Riboswitches: Modulation of RNA Function by Small Molecules. Biochemistry. Nov. 2, 2010;49(43):9123-31. doi: 10.1021/bi1012645.
Zhang et al., Stabilized plasmid-lipid particles for regional gene therapy: formulation and transfection properties. Gene Ther. Aug. 1999;6(8):1438-47.
Zhao et al., An ultraprocessive, accurate reverse transcriptase encoded by a metazoan group II intron. RNA. Feb. 2018;24(2):183-195. doi: 10.1261/rna.063479.117. Epub Nov. 6, 2017.
Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.
Zhao et al., Post-transcriptional gene regulation by mRNA modifications. Nat Rev Mol Cell Biol. Jan. 2017;18(1):31-42. doi: 10.1038/nrm.2016.132. Epub Nov. 3, 2016.
Zheng et al., ALKBH5 is a mammalian RNA demethylase that impacts RNA metabolism and mouse fertility. Mol Cell. Jan. 10, 2013;49(1):18-29. doi: 10.1016/j.molcel.2012.10.015. Epub Nov. 21, 2012.

(56) References Cited

OTHER PUBLICATIONS

Zheng et al., DNA editing in DNA/RNA hybrids by adenosine deaminases that act on RNA. Nucleic Acids Res. Apr. 7, 2017;45(6):3369-3377. doi: 10.1093/nar/gkx050.

Zheng et al., Highly efficient base editing in bacteria using a Cas9-cytidine deaminase fusion. Commun Biol. Apr. 19, 2018;1:32. doi: 10.1038/s42003-018-0035-5.

Zheng et al., Structural basis for the complete resistance of the human prion protein mutant G127V to prion disease. Sci Rep. Sep. 4, 2018;8(1):13211. doi: 10.1038/s41598-018-31394-6.

Zhong et al., Rational Design of Aptazyme Riboswitches for Efficient Control of Gene Expression in Mammalian Cells. Elife. Nov. 2, 2016;5:e18858. doi: 10.7554/eLife.18858.

Zhou et al., Cas12a variants designed for lower genome-wide off-target effect through stringent PAM recognition. Mol Ther. Jan. 5, 2022;30(1):244-255. doi: 10.1016/j.ymthe.2021.10.010. Epub Oct. 20, 2021.

Zhou et al., Dynamic m(6)A mRNA methylation directs translational control of heat shock response. Nature. Oct. 22, 2015;526(7574):591-4. doi: 10.1038/nature15377. Epub Oct. 12, 2015.

Zhou et al., GISSD: Group I Intron Sequence and Structure Database. Nucleic Acids Res. Jan. 2008;36(Database issue):D31-7. doi: 10.1093/nar/gkm766. Epub Oct. 16, 2007.

Zhou et al., Off-target RNA mutation induced by DNA base editing and its elimination by mutagenesis. Nature. Jul. 2019;571(7764):275-278. doi: 10.1038/s41586-019-1314-0. Epub Jun. 10, 2019.

Zhou et al., Protective V127 prion variant prevents prion disease by interrupting the formation of dimer and fibril from molecular dynamics simulations. Sci Rep. Feb. 24, 2016;6:21804. doi: 10.1038/srep21804.

Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.

Zielenski, Genotype and phenotype in cystic fibrosis. Respiration. 2000;67(2):117-33. doi: 10.1159/000029497.

Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.

Zimmerly et al., Group II intron mobility occurs by target DNA-primed reverse transcription. Cell. Aug. 25, 1995;82(4):545-54. doi: 10.1016/0092-8674(95)90027-6.

Zimmermann et al., Molecular interactions and metal binding in the theophylline-binding core of an RNA aptamer. RNA. May 2000;6(5):659-67.

Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.

Zorko et al., Cell-penetrating peptides: mechanism and kinetics of cargo delivery. Adv Drug Deliv Rev. Feb. 28, 2005;57(4):529-45. Epub Jan. 22, 2005.

Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.

Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.

Zuker et al., Optimal computer folding of large RNA sequences using thermodynamics and auxiliary information. Nucleic Acids Res. Jan. 10, 1981;9(1):133-48. doi: 10.1093/nar/9.1.133.

Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.

Zuris et al., Cationic lipid-mediated delivery of proteins enables efficient protein-based genome editing in vitro and in vivo. Nat Biotechnol. 2015;33:73-80.

[No Author Listed], "Lambda DNA" from Catalog & Technical Reference. New England Biolabs Inc. 2002/2003. pp. 133 and 270-273.

[No Author Listed], *Mus musculus* (Mouse). UniProtKB Accession No. P51908 (ABEC1_Mouse). Oct. 1, 1996. 10 pages.

Asokan et al., The AAV vector toolkit: poised at the clinical crossroads. Mol Ther. Apr. 2012;20(4):699-708. doi: 10.1038/mt.2011.287. Epub Jan. 24, 2012.

Auricchio et al., Exchange of surface proteins impacts on viral vector cellular specificity and transduction characteristics: the retina as a model. Hum Mol Genet. Dec. 15, 2001;10(26):3075-81. doi: 10.1093/hmg/10.26.3075.

Baba et al., Construction of *Escherichia coli* K-12 in-frame, single-gene knockout mutants: the Keio collection. Mol Syst Biol. 2006;2:2006.0008. doi: 10.1038/msb4100050. Epub Feb. 21, 2006.

Badran et al., In vivo continuous directed evolution. Curr Opin Chem Biol. Feb. 2015;24:1-10. doi: 10.1016/j.cbpa.2014.09.040. Epub Nov. 7, 2014.

Banno et al., Deaminase-mediated multiplex genome editing in *Escherichia coli*. Nat Microbiol. Apr. 2018;3(4):423-429. doi: 10.1038/s41564-017-0102-6. Epub Feb. 5, 2018.

Bass, B.L., RNA editing by adenosine deaminases that act on RNA. Annu Rev Biochem. 2002;71:817-46. doi: 10.1146/annurev.biochem.71.110601.135501. Epub Nov. 9, 2001.

Blauw et al., SMN1 gene duplications are associated with sporadic ALS. Neurology. Mar. 13, 2012;78(11):776-80. doi: 10.1212/WNL.0b013e318249f697. Epub Feb. 8, 2012.

Bothmer et al., Characterization of the interplay between DNA repair and CRISPR/Cas9-induced DNA lesions at an endogenous locus. Nat Commun. Jan. 9, 2017;8:13905. doi: 10.1038/ncomms13905.

Brierley et al., Viral RNA pseudoknots: versatile motifs in gene expression and replication. Nat Rev Microbiol. Aug. 2007;5(8):598-610. doi: 10.1038/nrmicro1704.

Canny et al., Inhibition of 53BP1 Favors Homology-Dependent DNA Repair and Increases CRISPR-Cas9 Genome-Editing Efficiency. Nat Biotechnol. Jan. 2018;36(1):95-102. doi: 10.1038/nbt.4021. Epub Nov. 27, 2017.

Cao et al., Rapamycin reverses cellular phenotypes and enhances mutant protein clearance in Hutchinson-Gilford progeria syndrome cells. Sci Transl Med. Jun. 29, 2011;3(89):89ra58. doi: 10.1126/scitranslmed.3002346.

Cartegni et al., Determinants of exon 7 splicing in the spinal muscular atrophy genes, SMN1 and SMN2. Am J Hum Genet. Jan. 2006;78(1):63-77. doi: 10.1086/498853. Epub Nov. 16, 2005.

Chang et al., Degradation of survival motor neuron (SMN) protein is mediated via the ubiquitin/proteasome pathway. Neurochem Int. Dec. 2004;45(7):1107-12. doi: 10.1016/j.neuint.2004.04.005.

Chatterjee et al., Robust Genome Editing of Single-Base PAM Targets; with Engineered ScCas9 Variants. bioRxiv. doi: 10.1101/620351. Posted Apr. 26, 2019.

Chen et al., Alterations in PMS2, MSH2 and MLH1 expression in human prostate cancer. Int J Oncol. May 2003;22(5):1033-43.

Cho et al., A degron created by SMN2 exon 7 skipping is a principal contributor to spinal muscular atrophy severity. Genes Dev. Mar. 1, 2010;24(5):438-42. doi: 10.1101/gad.1884910.

Choudhury et al., CRISPR/Cas9 recombineering-mediated deep mutational scanning of essential genes in *Escherichia coli*. Mol Syst Biol. Mar. 2020;16(3):e9265. doi: 10.15252/msb.20199265.

Corcia et al., The importance of the SMN genes in the genetics of sporadic ALS. Amyotroph Lateral Scler. Oct.-Dec. 2009;10(5-6):436-40. doi: 10.3109/17482960902759162.

Corti et al., Genetic correction of human induced pluripotent stem cells from patients with spinal muscular atrophy. Sci Transl Med. Dec. 19, 2012;4(165):165ra162. doi: 10.1126/scitranslmed.3004108.

Cucchiarini et al., Enhanced expression of the central survival of motor neuron (SMN) protein during the pathogenesis of osteoarthritis. J Cell Mol Med. Jan. 2014;18(1):115-24. doi: 10.1111/jcmm.12170. Epub Nov. 17, 2013.

(56) References Cited

OTHER PUBLICATIONS

D'Ydewalle et al., The Antisense Transcript SMN-AS1 Regulates SMN Expression and Is a Novel Therapeutic Target for Spinal Muscular Atrophy. Neuron. Jan. 4, 2017;93(1):66-79 and Supplemental Information. doi: 10.1016/j.neuron.2016.11.033. Epub Dec. 22, 2016.
Davis et al., Assaying Repair at DNA Nicks. Methods Enzymol. 2018;601:71-89. doi: 10.1016/bs.mie.2017.12.001. Epub Feb. 1, 2018.
Davis et al., Homology-directed repair of DNA nicks via pathways distinct from canonical double-strand break repair. Proc Natl Acad Sci U S A. Mar. 11, 2014;111(10):E924-32. doi: 10.1073/pnas. 1400236111. Epub Feb. 20, 2014.
Davis et al., Two Distinct Pathways Support Gene Correction by Single-Stranded Donors at DNA Nicks. Cell Rep. Nov. 8, 2016;17(7):1872-1881. doi: 10.1016/j.celrep.2016.10.049.
De Sandre-Giovannoli et al., Lamin a truncation in Hutchinson-Gilford progeria. Science. Jun. 27, 2003;300(5628):2055. doi: 10.1126/science.1084125. Epub Apr. 17, 2003.
Drenth et al., Mutations in sodium-channel gene SCN9A cause a spectrum of human genetic pain disorders. J Clin Invest. Dec. 2007;117(12):3603-9. doi: 10.1172/JCI33297.
Drost et al., Inactivation of DNA mismatch repair by variants of uncertain significance in the PMS2 gene. Hum Mutat. Nov. 2013;34(11):1477-80. doi: 10.1002/humu.22426. Epub Sep. 11, 2013.
Duan et al., Enhancement of muscle gene delivery with pseudotyped adeno-associated virus type 5 correlates with myoblast differentiation. J Virol. Aug. 2001;75(16):7662-71. doi: 10.1128/JVI.75.16.7662-7671.2001.
Dugar et al., CRISPR RNA-Dependent Binding and Cleavage of Endogenous RNAs by the Campylobacter jejuni Cas9. Mol Cell. Mar. 1, 2018;69(5):893-905.e7. doi: 10.1016/j.molcel.2018.01.032.
Eisenberg et al., A-to-I RNA editing—immune protector and transcriptome diversifier. Nat Rev Genet. Aug. 2018;19(8):473-490. doi: 10.1038/s41576-018-0006-1.
Filippova et al., Guide RNA modification as a way to improve CRISPR/Cas9-based genome-editing systems. Biochimie. Dec. 2019;167:49-60. doi: 10.1016/j.biochi.2019.09.003. Epub Sep. 4, 2019.
Friedman, J. H., Greedy function approximation: A gradient boosting machine. Ann. Statist. Oct. 2001;29(5):1189-232. doi: 10.1214/aos/1013203451.
GenBank Submission; NIH/NCBI, Accession No. NG_008692.2. McClintock et al., Aug. 27, 2018. 33 pages.
GenBank Submission; NIH/NCBI, Accession No. NP_001075493. 1. Schiaffella et al., Jun. 24, 2018. 2 pages.
GenBank Submission; NIH/NCBI, Accession No. NP_001157741. 1. Zeng et al., Sep. 17, 2018. 3 pages.
GenBank Submission; NIH/NCBI, Accession No. NP_001157742. 1. Zeng et al., Oct. 21, 2018. 3 pages.
GenBank Submission; NIH/NCBI, Accession No. NP_033040.2. Liu et al., Jun. 23, 2018. 2 pages.
GenBank Submission; NIH/NCBI, Accession No. XP_003314669. 1. No Author Listed, Mar. 20, 2018. 2 pages.
GenBank Submission; NIH/NCBI, Accession No. XP_026671085. 1. No Author Listed, Oct. 17, 2018. 1 page.
Gutschner et al., Post-translational Regulation of Cas9 during G1 Enhances Homology-Directed Repair. Cell Rep. Feb. 16, 2016;14(6):1555-1566. doi: 10.1016/j.celrep.2016.01.019. Epub Feb. 4, 2016.
Halbert et al., Repeat transduction in the mouse lung by using adeno-associated virus vectors with different serotypes. J Virol. Feb. 2000;74(3):1524-32. doi: 10.1128/jvi.74.3.1524-1532.2000.
Hardt et al.,Missense variants in hMLH1 identified in patients from the German HNPCC consortium and functional studies. Fam Cancer. Jun. 2011;10(2):273-84. doi: 10.1007/s10689-011-9431-4.

Harmsen et al., DNA mismatch repair and oligonucleotide end-protection promote base-pair substitution distal from a CRISPR/Cas9-induced DNA break. Nucleic Acids Res. Apr. 6, 2018;46(6):2945-2955. doi: 10.1093/nar/gky076.
Harrington et al., Programmed DNA destruction by miniature CRISPR-Cas14 enzymes. Science. Nov. 16, 2018;362(6416):839-842. doi: 10.1126/science.aav4294. Epub Oct. 18, 2018.
Hart et al., High-Resolution CRISPR Screens Reveal Fitness Genes and Genotype-Specific Cancer Liabilities. Cell. Dec. 3, 2015;163(6):1515-26. doi: 10.1016/j.cell.2015.11.015. Epub Nov. 25, 2015.
Hilbers et al., New developments in structure determination of pseudoknots. Biopolymers. 1998;48(2-3):137-53. doi: 10.1002/(SICI)1097-0282(1998)48:2<137::AID-BIP4>3.0.CO;2-H.
Huang et al., Gain-of-function mutations in sodium channel Na(v)1.9 in painful neuropathy. Brain. Jun. 2014;137(Pt 6):1627-42. doi: 10.1093/brain/awu079. Epub Apr. 27, 2014.
Isaacs et al., Engineered riboregulators enable post-transcriptional control of gene expression. Nat Biotechnol. Jul. 2004;22(7):841-7. doi: 10.1038/nbt986. Epub Jun. 20, 2004.
Ishizuka et al., Loss of ADAR1 in tumours overcomes resistance to immune checkpoint blockade. Nature. Jan. 2019;565(7737):43-48. doi: 10.1038/s41586-018-0768-9. Epub Dec. 17, 2018.
Iyama et al., DNA repair mechanisms in dividing and non-dividing cells. DNA Repair (Amst). Aug. 2013;12(8):620-36. doi: 10.1016/j.dnarep.2013.04.015. Epub May 16, 2013.
Jia et al., The MLH1 ATPase domain is needed for suppressing aberrant formation of interstitial telomeric sequences. DNA Repair (Amst). May 2018;65:20-25. doi: 10.1016/j.dnarep.2018.03.002. Epub Mar. 7, 2018.
Kan et al., Mechanisms of precise genome editing using oligonucleotide donors. Genome Res. Jul. 2017;27(7):1099-1111. doi: 10.1101/gr.214775.116. Epub Mar. 29, 2017.
Kim et al., Adenine base editors catalyze cytosine conversions in human cells. Nat Biotechnol. Oct. 2019;37(10):1145-1148. doi: 10.1038/s41587-019-0254-4. Epub Sep. 23, 2019.
Kim et al., RAD51 mutants cause replication defects and chromosomal instability. Mol Cell Biol. Sep. 2012;32(18):3663-80. doi: 10.1128/MCB.00406-12. Epub Jul. 9, 2012.
Knott et al., CRISPR-Cas guides the future of genetic engineering. Science. Aug. 31, 2018;361(6405):866-869. doi: 10.1126/science.aat5011.
Kweon et al., A CRISPR-based base-editing screen for the functional assessment of BRCA1 variants. Oncogene. Jan. 2020;39(1):30-35. doi: 10.1038/s41388-019-0968-2. Epub Aug. 29, 2019.
Le et al., SMNDelta7, the major product of the centromeric survival motor neuron (SMN2) gene, extends survival in mice with spinal muscular atrophy and associates with full-length SMN. Hum Mol Genet. Mar. 15, 2005;14(6):845-57. doi: 10.1093/hmg/ddi078. Epub Feb. 9, 2005.
Lefebvre et al., Identification and characterization of a spinal muscular atrophy-determining gene. Cell. Jan. 13, 1995;80(1):155-65. doi: 10.1016/0092-8674(95)90460-3.
Li et al., Programmable Single and Multiplex Base-Editing in Bombyx mori Using RNA-Guided Cytidine Deaminases. G3 (Bethesda). May 4, 2018;8(5):1701-1709. doi: 10.1534/g3.118.200134.
Liao et al., One-step assembly of large CRISPR arrays enables multi-functional targeting and reveals constraints on array design. bioRxiv. May 2, 2018. doi: 10.1101/312421. 45 pages.
Lin et al., [Construction and evaluation of DnaB split intein high expression vector and a six amino acids cyclic peptide library]. Sheng Wu Gong Cheng Xue Bao. Nov. 2008;24(11):1924-30. Chinese.
Lin et al., Base editing-mediated splicing correction therapy for spinal muscular atrophy. Cell Res. Jun. 2020;30(6):548-550. doi: 10.1038/s41422-020-0304-y. Epub Mar. 24, 2020.
Lindahl, T., Instability and decay of the primary structure of DNA. Nature. Apr. 22, 1993;362(6422):709-15. doi: 10.1038/362709a0.
Liu et al., Human BRCA2 protein promotes RAD51 filament formation on RPA-covered single-stranded DNA. Nat Struct Mol Biol. Oct. 2010;17(10):1260-2. doi: 10.1038/nsmb.1904. Epub Aug. 22, 2010.

(56) References Cited

OTHER PUBLICATIONS

Liu et al., Improving Editing Efficiency for the Sequences with NGH PAM Using xCas9-Derived Base Editors. Mol Ther Nucleic Acids. Sep. 6, 2019;17:626-635. doi: 10.1016/j.omtn.2019.06.024. Epub Jul. 12, 2019.

Liu et al., Intrinsic Nucleotide Preference of Diversifying Base Editors Guides Antibody Ex Vivo Affinity Maturation. Cell Rep. Oct. 23, 2018;25(4):884-892.e3. doi: 10.1016/j.celrep.2018.09.090.

Lorson et al., A single nucleotide in the SMN gene regulates splicing and is responsible for spinal muscular atrophy. Proc Natl Acad Sci U S A. May 25, 1999;96(11):6307-11. doi: 10.1073/pnas.96.11.6307.

Lutz et al., Postsymptomatic restoration of SMN rescues the disease phenotype in a mouse model of severe spinal muscular atrophy. J Clin Invest. Aug. 2011;121(8):3029-41. doi: 10.1172/JCI57291. Epub Jul. 25, 2011.

Ma et al., Human RAD52 interactions with replication protein A and the RAD51 presynaptic complex. J Biol Chem. Jul. 14, 2017;292(28):11702-11713. doi: 10.1074/jbc.M117.794545. Epub May 27, 2017.

Marsden et al., The Tumor-Associated Variant RAD51 G151D Induces a Hyper-Recombination Phenotype. PLoS Genet. Aug. 11, 2016;12(8):e1006208. doi: 10.1371/journal.pgen.1006208.

Mason et al., Non-enzymatic roles of human RAD51 at stalled replication forks. bioRxiv. Jul. 31, 2019; doi.org/10.1101/359380. 36 pages. bioRxiv preprint first posted online Jul. 31, 2019.

Mendell et al., Single-Dose Gene-Replacement Therapy for Spinal Muscular Atrophy. N Engl J Med. Nov. 2, 2017;377(18):1713-1722. doi: 10.1056/NEJMoa1706198.

Monani et al., A single nucleotide difference that alters splicing patterns distinguishes the SMA gene SMN1 from the copy gene SMN2. Hum Mol Genet. Jul. 1999;8(7):1177-83. doi: 10.1093/hmg/8.7.1177.

Mootz et al., Protein splicing triggered by a small molecule. J Am Chem Soc. Aug. 7, 2002;124(31):9044-5 and Supporting Information. doi: 10.1021/ja0267690. 4 pages.

Murray et al., Selective vulnerability of motor neurons and dissociation of pre- and post-synaptic pathology at the neuromuscular junction in mouse models of spinal muscular atrophy. Hum Mol Genet. Apr. 1, 2008;17(7):949-62. doi: 10.1093/hmg/ddm367. Epub Dec. 8, 2007.

Murugan et al., The Revolution Continues: Newly Discovered Systems Expand the CRISPR-Cas Toolkit. Mol Cell. Oct. 5, 2017;68(1):15-25. doi: 10.1016/j.molcel.2017.09.007.

Nelson et al., In vivo genome editing improves muscle function in a mouse model of Duchenne muscular dystrophy. Science. Jan. 22, 2016;351(6271):403-7. doi: 10.1126/science.aad5143. Epub Dec. 31, 2015.

Nelson et al., The unstable repeats—three evolving faces of neurological disease. Neuron. Mar. 6, 2013;77(5):825-43. doi: 10.1016/j.neuron.2013.02.022.

Noack et al., Epitranscriptomics: A New Regulatory Mechanism of Brain Development and Function. Front Neurosci. Feb. 20, 2018;12:85. doi: 10.3389/fnins.2018.00085. 9 pages.

Ottesen, ISS-N1 makes the First FDA-approved Drug for Spinal Muscular Atrophy. Transl Neurosci. Jan. 26, 2017;8:1-6. doi: 10.1515/tnsci-2017-0001.

Parente et al., Advances in spinal muscular atrophy therapeutics. Ther Adv Neurol Disord. Feb. 5, 2018;11:1756285618754501. doi: 10.1177/1756285618754501. 13 pages.

Passini et al., Antisense oligonucleotides delivered to the mouse CNS ameliorate symptoms of severe spinal muscular atrophy. Sci Transl Med. Mar. 2, 2011;3(72):72ra18. doi: 10.1126/scitranslmed.3001777.

Pellegrini et al., Insights into DNA recombination from the structure of a RAD51-BRCA2 complex. Nature. Nov. 21, 2002;420(6913):287-93. doi: 10.1038/nature01230. Epub Nov. 10, 2002.

Perez-Palma et al., Simple ClinVar: an interactive web server to explore and retrieve gene and disease variants aggregated in ClinVar database. Nucleic Acids Res. Jul. 2, 2019;47(W1):W99-W105. doi: 10.1093/nar/gkz411.

Pieken et al., Kinetic characterization of ribonuclease-resistant 2'-modified hammerhead ribozymes. Science. Jul. 19, 1991;253(5017):314-7. doi: 10.1126/science.1857967.

Porensky et al., a single administration of morpholino antisense oligomer rescues spinal muscular atrophy in mouse. Hum Mol Genet. Apr. 1, 2012;21(7):1625-38. doi: 10.1093/hmg/ddr600. Epub Dec. 20, 2011.

Prasad et al., Visualizing the assembly of human Rad51 filaments on double-stranded DNA. J Mol Biol. Oct. 27, 2006;363(3):713-28. doi: 10.1016/j.jmb.2006.08.046. Epub Aug. 22, 2006.

Rajagopal et al., High-throughput mapping of regulatory DNA. Nat Biotechnol. Feb. 2016;34(2):167-74. doi: 10.1038/nbt.3468. Epub Jan. 25, 2016.

Ramos et al., Age-dependent SMN expression in disease-relevant tissue and implications for SMA treatment. J Clin Invest. Nov. 1, 2019;129(11):4817-4831. doi: 10.1172/JCI124120.

Richardson et al., CRISPR-Cas9 genome editing in human cells occurs via the Fanconi anemia pathway. Nat Genet. Aug. 2018;50(8):1132-1139. doi: 10.1038/s41588-018-0174-0. Epub Jul. 27, 2018.

Richardson et al., Frequent chromosomal translocations induced by DNA double-strand breaks. Nature. Jun. 8, 2000;405(6787):697-700. doi: 10.1038/35015097.

Rodriguez-Muela et al., Single-Cell Analysis of SMN Reveals Its Broader Role in Neuromuscular Disease. Cell Rep. Feb. 7, 2017;18(6):1484-1498 and Supplemental Information. doi: 10.1016/j.celrep.2017.01.035.

Safari et al., CRISPR Cpf1 proteins: structure, function and implications for genome editing. Cell Biosci. May 9, 2019;9:36. doi: 10.1186/s13578-019-0298-7.

San Filippo et al., Mechanism of eukaryotic homologous recombination. Annu Rev Biochem. 2008;77:229-57. doi: 10.1146/annurev.biochem.77.061306.125255.

Schlacher et al., Double-strand break repair-independent role for BRCA2 in blocking stalled replication fork degradation by MRE11. Cell. May 13, 2011;145(4):529-42. doi: 10.1016/j.cell.2011.03.041. Erratum in: Cell. Jun. 10, 2011;145(6):993.

Schrank et al., Inactivation of the survival motor neuron gene, a candidate gene for human spinal muscular atrophy, leads to massive cell death in early mouse embryos. Proc Natl Acad Sci USA. Sep. 2, 1997;94(18):9920-5. doi: 10.1073/pnas.94.18.9920.

Shen et al., Efficient genome modification by CRISPR-Cas9 nickase with minimal off-target effects. Nat Methods. Apr. 2014;11(4):399-402. doi: 10.1038/nmeth.2857. Epub Mar. 2, 2014.

Singh et al., Splicing of a critical exon of human Survival Motor Neuron is regulated by a unique silencer element located in the last intron. Mol Cell Biol. Feb. 2006;26(4):1333-46. doi: 10.1128/MCB.26.4.1333-1346.2006.

Song et al., RS-1 enhances CRISPR/Cas9- and TALEN-mediated knock-in efficiency. Nat Commun. Jan. 28, 2016;7:10548. doi: 10.1038/ncomms10548.

Stark et al., ATP hydrolysis by mammalian RAD51 has a key role during homology-directed DNA repair. J Biol Chem. Jun. 7, 2002;277(23):20185-94. doi: 10.1074/jbc.M112132200. Epub Mar. 28, 2002.

Sumner et al., Two breakthrough gene-targeted treatments for spinal muscular atrophy: challenges remain. J Clin Invest. Aug. 1, 2018;128(8):3219-3227. doi: 10.1172/JCI121658. Epub Jul. 9, 2018.

Talbot et al., Spinal muscular atrophy. Semin Neurol. Jun. 2001;21(2):189-97. doi: 10.1055/s-2001-15264.

Tan et al., Engineering of high-precision base editors for site-specific single nucleotide replacement. Nat Commun. Jan. 25, 2019;10(1):439. doi: 10.1038/s41467-018-08034-8. Erratum in: Nat Commun. May 1, 2019;10(1):2019.

Thompson et al., The Future of Multiplexed Eukaryotic Genome Engineering. ACS Chem Biol. Feb. 16, 2018;13(2):313-325. doi: 10.1021/acschembio.7b00842. Epub Dec. 28, 2017.

(56) References Cited

OTHER PUBLICATIONS

Trojan et al., Functional analysis of hMLH1 variants and HNPCC-related mutations using a human expression system. Gastroenterology. Jan. 2002;122(1):211-9. doi: 10.1053/gast.2002.30296.
Tsai et al., Guide-seq enables genome-wide profiling of off-target cleavage by CRISPR-Cas nucleases. Nat Biotechnol. Feb. 2015;33(2):187-197. doi: 10.1038/nbt.3117. Epub Dec. 16, 2014.
Vakulskas et al., A high-fidelity Cas9 mutant delivered as a ribonucleoprotein complex enables efficient gene editing in human hematopoietic stem and progenitor cells. Nat Med. Aug. 2018;24(8):1216-1224. doi: 10.1038/s41591-018-0137-0. Epub Aug. 6, 2018.
Van Den Oord et al., Pixel Recurrent Neural Networks. Proceedings of the 33rd International Conference on Machine Learning. Journal of Machine Learning Research. Aug. 19, 2016. vol. 48. 11 pages.
Wills et al., Pseudoknot-dependent read-through of retroviral gag termination codons: importance of sequences in the spacer and loop 2. EMBO J. Sep. 1, 1994;13(17):4137-44. doi: 10.1002/j.1460-2075.1994.tb06731.x.
Wirth et al., Mildly affected patients with spinal muscular atrophy are partially protected by an increased SMN2 copy number. Hum Genet. May 2006;119(4):422-8. doi: 10.1007/s00439-006-0156-7. Epub Mar. 1, 2006.
Woo et al., Gene activation of SMN by selective disruption of lncRNA-mediated recruitment of PRC2 for the treatment of spinal muscular atrophy. Proc Natl Acad Sci U S A. Feb. 21, 2017;114(8):E1509-E1518. doi: 10.1073/pnas.1616521114. Epub Feb. 13, 2017.
Wu et al., A novel SCN9A mutation responsible for primary erythromelalgia and is resistant to the treatment of sodium channel blockers. PLoS One. 2013;8(1):e55212. doi: 10.1371/journal.pone.0055212. Epub Jan. 31, 2013. 15 pages.
Yamane et al., Deep-sequencing identification of the genomic targets of the cytidine deaminase AID and its cofactor RPA in B lymphocytes. Nat Immunol. Jan. 2011;12(1):62-9. doi: 10.1038/ni.1964. Epub Nov. 28, 2010.
Yang et al., BRCA2 function in DNA binding and recombination from a BRCA2-DSS1-ssDNA structure. Science. Sep. 13, 2002;297(5588):1837-48. doi: 10.1126/science.297.5588.1837.
Yang et al., Genome-wide inactivation of porcine endogenous retroviruses (PERVs). Science. Nov. 27, 2015;350(6264):1101-4. doi: 10.1126/science.aad1191. Epub Oct. 11, 2015.
Yang et al., The BRCA2 homologue Brh2 nucleates RAD51 filament formation at a dsDNA-ssDNA junction. Nature. Feb. 10, 2005;433(7026):653-7. doi: 10.1038/nature03234.
Yu et al., Dynamic control of Rad51 recombinase by self-association and interaction with BRCA2. Mol Cell. Oct. 2003;12(4):1029-41. doi: 10.1016/s1097-2765(03)00394-0.
Zhang et al., Efficient precise knockin with a double cut HDR donor after CRISPR/Cas9-mediated double-stranded DNA cleavage. Genome Biol. Feb. 20, 2017;18(1):35. doi: 10.1186/s13059-017-1164-8.
Zhang et al., Large genomic fragment deletions and insertions in mouse using CRISPR/Cas9. PLoS One. Mar. 24, 2015;10(3):e0120396. doi: 10.1371/journal.pone.0120396. 14 pages.
Zolotukhin et al., Production and purification of serotype 1, 2, and 5 recombinant adeno-associated viral vectors. Methods. Oct. 2002;28(2):158-67. doi: 10.1016/s1046-2023(02)00220-7.
[No Author Listed], Gag-Pol polyprotein. UniProtKB/Swiss-Prot No. P03355.5. Sep. 18, 2019. 18 pages.
[No Author Listed], *Homo sapiens* signal transducer and activator of transcription 3 (STAT3), transcript variant 1, mRNA. NCBI Ref Seq No. NM_139276.2. Retrived from https://www.ncbi.nlm.nih.gov/nuccore/nm_139276.2. Feb. 26, 2020. 8 pages.
Ai et al., C-terminal Loop Mutations Determine Folding and Secretion Properties of PCSK9. iMedPub J: Biochem Mol Biol J. Nov. 5, 2016;2(3):17. doi: 10.21767/2471-8084.100026. 12 pages.
Anzalone et al., Search-and-replace genome editing without double-strand breaks or donor DNA. Nature. Dec. 2019;576(7785):149-157 and Suppl Info. doi: 10.1038/s41586-019-1711-4. Epub Oct. 21, 2019. 72 pages.

Basila et al., Minimal 2'-O-methyl phosphorothioate linkage modification pattern of synthetic guide RNAs for increased stability and efficient CRISPR-Cas9 gene editing avoiding cellular toxicity. PLoS One. Nov. 27, 2017;12(11):e0188593. doi: 10.1371/journal.pone.0188593.
Bertsimas et al., Simulated annealing. Statistical Science. Feb. 1993;8(1):10-15. doi: 10.1214/ss/1177011077.
Bibikova et al., Targeted chromosomal cleavage and mutagenesis in *Drosophila* using zinc-finger nucleases. Genetics. Jul. 2002;161(3):1169-75. doi: 10.1093/genetics/161.3.1169.
Brutlag et al., Improved sensitivity of biological sequence database searches. Comput Appl Biosci. Jul. 1990;6(3):237-45. doi: 10.1093/bioinformatics/6.3.237.
Carlier et al., Genome Sequence of Burkholderia cenocepacia H111, a Cystic Fibrosis Airway Isolate. Genome Announc. Apr. 10, 2014;2(2):e00298-14. doi: 10.1128/genomeA.00298-14.
Chen et al., Dynamic imaging of genomic loci in living human cells by an optimized CRISPR/Cas system. Cell. Dec. 19, 2013;155(7):1479-91. doi: 10.1016/j.cell.2013.12.001. Erratum in: Cell. Jan. 16, 2014;156(1-2):373.
Cheng et al., [Cloning,expression and activity identification of human innate immune protein apolipoprotein B mRNA editing enzyme catalytic subunit 3A(APOBEC3A)]. Xi Bao Yu Fen Zi Mian Yi Xue Za Zhi. Chinese Journal of Cellular and Molecular Immunology, Feb. 2017;33(2):179-84. Chinese.
Dickinson et al., A system for the continuous directed evolution of proteases rapidly reveals drug-resistance mutations. Nat Commun. Oct. 30, 2014;5:5352. doi: 10.1038/ncomms6352.
Ekstrand et al., Frequent alterations of the PI3K/AKT/mTOR pathways in hereditary nonpolyposis colorectal cancer. Fam Cancer. Jun. 2010;9(2):125-9. doi: 10.1007/s10689-009-9293-1.
Entin-Meer et al., The role of phenylalanine-119 of the reverse transcriptase of mouse mammary tumour virus in DNA synthesis, ribose selection and drug resistance. Biochem J. Oct. 15, 2002;367(Pt 2):381-91. doi: 10.1042/BJ20020712.
Fang et al., The Menu of Features that Define Primary MicroRNAs and Enable De Novo Design of MicroRNA Genes. Mol Cell. Oct. 1, 2015;60(1):131-45. doi: 10.1016/j.molcel.2015.08.015. Epub Sep. 24, 2015.
Feng et al., Efficient genome editing in plants using a CRISPR/Cas system. Cell Res. Oct. 2013;23(10):1229-32. doi: 10.1038/cr.2013.114. Epub Aug. 20, 2013.
Geisberg et al., Global analysis of mRNA isoform half-lives reveals stabilizing and destabilizing elements in yeast. Cell. Feb. 13, 2014;156(4):812-24. doi: 10.1016/j.cell.2013.12.026.
GenBank Submission; NIH/NCBI, Accession No. NC_000001.11. Gregory et al., Jun. 6, 2016. 3 pages.
GenBank Submission; NIH/NCBI, Accession No. NM_206933.2. Khalaileh et al., Sep. 16, 2018. 12 pages.
GenBank Submission; NIH/NCBI, Accession No. NP_996816.2. Fu et al., Sep. 22, 2019. 9 pages.
Grati et al., Localization of PDZD7 to the stereocilia ankle-link associates this scaffolding protein with the Usher syndrome protein network. J Neurosci. Oct. 10, 2012;32(41):14288-93. doi: 10.1523/JNEUROSCI.3071-12.2012.
Green et al., Characterization of the mechanical unfolding of RNA pseudoknots. J Mol Biol. Jan. 11, 2008;375(2):511-28. doi: 10.1016/j.jmb.2007.05.058. Epub May 26, 2007.
Hagen et al., A high rate of polymerization during synthesis of mouse mammary tumor virus DNA alleviates hypermutation by APOBEC3 proteins. PLoS Pathog. Feb. 15, 2019;15(2):e1007533. doi: 10.1371/journal.ppat.1007533.
Hawley-Nelson et al., Transfection of Cultured Eukaryotic Cells Using Cationic Lipid Reagents. Curr Prot Mol Biol. Jan. 2008;9.4.1-9.4.17. doi: 10.102/0471142727.mb0904s81. 17 pages.
Hendel et al., Chemically modified guide RNAs enhance CRISPR-Cas genome editing in human primary cells. Nat Biotechnol. Sep. 2015;33(9):985-989. doi: 10.1038/nbt.3290. Epub Jun. 29, 2015. Author Manuscript. 14 pages.
Heyer et al., Regulation of homologous recombination in eukaryotes. Annu Rev Genet. 2010;44:113-39. doi: 10.1146/annurev-genet-051710-150955. Author Manuscript. 33 pages.

(56) References Cited

OTHER PUBLICATIONS

Houck-Loomis et al., An equilibrium-dependent retroviral mRNA switch regulates translational recoding. Nature. Nov. 27, 2011;480(7378):561-4. doi: 10.1038/nature10657.

Houseley et al., The many pathways of RNA degradation. Cell. Feb. 20, 2009;136(4):763-76. doi: 10.1016/j.cell.2009.01.019.

Hänsel-Hertsch et al., DNA G-quadruplexes in the human genome: detection, functions and therapeutic potential. Nat Rev Mol Cell Biol. May 2017;18(5):279-284. doi: 10.1038/nrm.2017.3. Epub Feb. 22, 2017.

Ibrahim et al., RNA recognition by 3'-to-5' exonucleases: the substrate perspective. Biochim Biophys Acta. Apr. 2008;1779(4):256-65. doi: 10.1016/j.bbagrm.2007.11.004. Epub Dec. 3, 2007.

Jakimo et al., A Cas9 with Complete PAM Recognition for Adenine Dinucleotides. bioRxiv preprint. Sep. 27, 2018. doi.org/10.1101/429654. 29 pages.

Jost et al., Titrating gene expression using libraries of systematically attenuated CRISPR guide RNAs. Nat Biotechnol. Mar. 2020;38(3):355-364. doi: 10.1038/s41587-019-0387-5. Epub Jan. 13, 2020.

Konishi et al., Amino acid substitutions away from the RNase H catalytic site increase the thermal stability of Moloney murine leukemia virus reverse transcriptase through RNase H inactivation. Biochem Biophys Res Commun. Nov. 14, 2014;454(2):269-74. doi: 10.1016/j.bbrc.2014.10.044. Epub Oct. 17, 2014.

Ku et al., Nucleic Acid Aptamers: An Emerging Tool for Biotechnology and Biomedical Sensing. Sensors (Basel). Jul. 6, 2015;15(7):16281-313. doi: 10.3390/s150716281.

Kuan et al., A systematic evaluation of nucleotide properties for CRISPR sgRNA design. BMC Bioinformatics. Jun. 6, 2017;18(1):297. doi: 10.1186/s12859-017-1697-6.

Kwok et al., G-Quadruplexes: Prediction, Characterization, and Biological Application. Trends Biotechnol. Oct. 2017;35(10):997-1013. doi: 10.1016/j.tibtech.2017.06.012. Epub Jul. 26, 2017.

Langer et al., Chemical and Physical Structure of Polymers as Carriers for Controlled Release of Bioactive Agents: A Review. J Macromol Sci, Part C, 1983;23(1):61-126. doi: 10.1080/07366578308079439.

Lesinski et al., The potential for targeting the STAT3 pathway as a novel therapy for melanoma. Future Oncol. Jul. 2013;9(7):925-7. doi: 10.2217/fon.13.83. Author Manuscript. 4 pages.

Liu et al., Usherin is required for maintenance of retinal photoreceptors and normal development of cochlear hair cells. Proc Natl Acad Sci U S A. Mar. 13, 2007;104(11):4413-8. doi: 10.1073/pnas.0610950104. Epub Mar. 5, 2007.

Longsworth, Expanding the Enzymatic Activity of the Programmable Endonuclease Cas9 in Zebrafish. Thesis. Rice University. Houston, TX. Aug. 2018. 41 pages.

MacFadden et al., Mechanism and structural diversity of exoribonuclease-resistant RNA structures in flaviviral RNAs. Nat Commun. Jan. 9, 2018;9(1):119. doi: 10.1038/s41467-017-02604-y.

Maerker et al., A novel Usher protein network at the periciliary reloading point between molecular transport machineries in vertebrate photoreceptor cells. Hum Mol Genet. Jan. 1, 2008;17(1):71-86. doi: 10.1093/hmg/ddm285. Epub Sep. 28, 2007.

Mahoney et al., The Next Immune-Checkpoint Inhibitors: PD-1/PD-L1 Blockade in Melanoma. Clin Ther. Apr. 1, 2015;37(4):764-82. doi: 10.1016/j.clinthera.2015.02.018. Epub Mar. 29, 2015.

Mangeot et al., Genome editing in primary cells and in vivo using viral-derived Nanoblades loaded with Cas9-sgRNA ribonucleoproteins. Nat Commun. Jan. 3, 2019;10(1):45. doi: 10.1038/s41467-018-07845-z.

Marcovitz et al., Frustration in protein-DNA binding influences conformational switching and target search kinetics. Proc Natl Acad Sci U S A. Nov. 1, 2011;108(44):17957-62. doi: 10.1073/pnas.1109594108. Epub Oct. 14, 2011.

Micozzi et al., Human cytidine deaminase: a biochemical characterization of its naturally occurring variants. Int J Biol Macromol. Feb. 2014;63:64-74. doi: 10.1016/j.ijbiomac.2013.10.029. Epub Oct. 29, 2013. Erratum in: Int J Biol Macromol. Feb. 2014;63:262.

Millevoi et al., G-quadruplexes in RNA biology. Wiley Interdiscip Rev RNA. Jul.-Aug. 2012;3(4):495-507. doi: 10.1002/wrna.1113. Epub Apr. 4, 2012.

Min et al., Deep learning in bioinformatics. Brief Bioinform. Sep. 1, 2017;18(5):851-869. doi: 10.1093/bib/bbw068.

Ousterout et al., Multiplex CRISPR/Cas9-based genome editing for correction of dystrophin mutations that cause Duchenne muscular dystrophy. Nat Commun. Feb. 18, 2015;6:6244. doi: 10.1038/ncomms7244.

Pandey et al., Effect of loops and G-quartets on the stability of RNA G-quadruplexes. J Phys Chem B. Jun. 13, 2013;117(23):6896-905. doi: 10.1021/jp401739m. Epub May 29, 2013. Supplementary Information, 21 pages.

Pendse et al., Exon 13-skipped USH2A protein retains functional integrity in mice, suggesting an exo-skipping therapeutic approach to treat USH2A-associated disease. bioRxiv preprint. Feb. 4, 2020. Retrieved from www.biorxiv.org. doi: 10.1101/2020.02.04.934240. 34 pages.

Pendse et al., In Vivo Assessment of Potential Therapeutic Approaches for USH2A-Associated Diseases. Adv Exp Med Biol. 2019;1185:91-96. doi: 10.1007/978-3-030-27378-1_15.

Petit et al., Powerful mutators lurking in the genome. Philos Trans R Soc Lond B Biol Sci. Mar. 12, 2009;364(1517):705-15. doi: 10.1098/rstb.2008.0272.

Pijlman et al., A highly structured, nuclease-resistant, noncoding RNA produced by flaviviruses is required for pathogenicity. Cell Host Microbe. Dec. 11, 2008;4(6):579-91. doi: 10.1016/j.chom.2008.10.007.

Piotukh et al., Directed evolution of sortase A mutants with altered substrate selectivity profiles. J Am Chem Soc. Nov. 9, 2011;133(44):17536-9. doi: 10.1021/ja205630g. Epub Oct. 13, 2011.

Reiners et al., Scaffold protein harmonin (USH1C) provides molecular links between Usher syndrome type 1 and type 2. Hum Mol Genet. Dec. 15, 2005;14(24):3933-43. doi: 10.1093/hmg/ddi417. Epub Nov. 21, 2005.

Robert et al., Virus-Like Particles Derived from HIV-1 for Delivery of Nuclear Proteins: Improvement of Production and Activity by Protein Engineering. Mol Biotechnol. Jan. 2017;59(1):9-23. doi: 10.1007/s12033-016-9987-1.

Saayman et al., The therapeutic application of CRISPR/Cas9 technologies for HIV. Expert Opin Biol Ther. Jun. 2015;15(6):819-30. doi: 10.1517/14712598.2015.1036736. Epub Apr. 12, 2015.

Sanjurjo-Soriano et al., Genome Editing in Patient iPSCs Corrects the Most Prevalent USH2A Mutations and Reveals Intriguing Mutant mRNA Expression Profiles. Mol Ther Methods Clin Dev. Nov. 27, 2019;17:156-173. doi: 10.1016/j.omtm.2019.11.016.

Sorusch et al., Characterization of the ternary Usher syndrome SANS/ush2a/whirlin protein complex. Hum Mol Genet. Mar. 15, 2017;26(6):1157-1172. doi: 10.1093/hmg/ddx027.

Steckelberg et al., A folded viral noncoding RNA blocks host cell exoribonucleases through a conformationally dynamic RNA structure. Proc Natl Acad Sci U S A. Jun. 19, 2018;115(25):6404-6409. doi: 10.1073/pnas.1802429115. Epub Jun. 4, 2018.

Vidal et al., Yeast forward and reverse 'n'-hybrid systems. Nucleic Acids Res. Feb. 15, 1999;27(4):919-29. doi: 10.1093/nar/27.4.919.

Wu et al., MLV based viral-like-particles for delivery of toxic proteins and nuclear transcription factors. Biomaterials. Sep. 2014;35(29):8416-26. doi: 10.1016/j.biomaterials.2014.06.006. Epub Jul. 3, 2014.

Wu et al., Widespread Influence of 3'-End Structures on Mammalian mRNA Processing and Stability. Cell. May 18, 2017;169(5):905-917.e11. doi: 10.1016/j.cell.2017.04.036.

Yi et al., Engineering of TEV protease variants by yeast ER sequestration screening (YESS) of combinatorial libraries. Proc Natl Acad Sci U S A. Apr. 30, 2013;110(18):7229-34. doi: 10.1073/pnas.1215994110. Epub Apr. 15, 2013.

Zhu et al., Novel Thrombotic Function of a Human SNP in STXBP5 Revealed by CRISPR/Cas9 Gene Editing in Mice. Arterioscler Thromb Vasc Biol. Feb. 2017;37(2):264-270. doi: 10.1161/ATVBAHA.116.308614. Epub Dec. 29, 2016.

U.S. Appl. No. 17/289,665, filed Apr. 28, 2021, Liu et al.
U.S. Appl. No. 16/756,432, filed Apr. 15, 2020, Liu et al.
U.S. Appl. No. 16/772,747, filed Jun. 12, 2020, Shen et al.

(56) References Cited

OTHER PUBLICATIONS

U.S. Appl. No. 17/425,261, filed Jul. 22, 2021, Kim et al.
U.S. Appl. No. 17/057,398, filed Nov. 20, 2020, Liu et al.
U.S. Appl. No. 17/259,147, filed Jan. 8, 2021, Liu et al.
U.S. Appl. No. 17/270,396, filed Feb. 22, 2021, Liu et al.
U.S. Appl. No. 17/273,688, filed Mar. 4, 2021, Liu et al.
U.S. Appl. No. 17/294,287, filed May 14, 2021, Liu et al.
U.S. Appl. No. 17/288,504, filed Apr. 23, 2021, Liu et al.
U.S. Appl. No. 17/633,573, filed Feb. 7, 2022, Liu et al.
U.S. Appl. No. 17/910,552, filed Sep. 9, 2022, Liu et al.
U.S. Appl. No. 17/436,048, filed Sep. 2, 2021, Liu et al.
U.S. Appl. No. 17/219,590, filed Mar. 31, 2021, Liu et al.
U.S. Appl. No. 17/603,917, filed Oct. 14, 2021, Liu et al.
U.S. Appl. No. 17/797,700, filed Aug. 4, 2022, Liu et al.
U.S. Appl. No. 17/602,738, filed Oct. 8, 2021, Liu et al.
U.S. Appl. No. 17/613,025, filed Nov. 19, 2021, Liu et al.
U.S. Appl. No. 17/300,668, filed Sep. 17, 2021, Liu et al.
U.S. Appl. No. 17/795,819, filed Jul. 27, 2022, Liu et al.
U.S. Appl. No. 17/779,953, filed May 25, 2022, Liu et al.
U.S. Appl. No. 17/767,777, filed Apr. 8, 2022, Liu et al.
U.S. Appl. No. 17/797,701, filed Aug. 4, 2022, Liu et al.
U.S. Appl. No. 18/053,269, filed Nov. 7, 2022, Liu et al.
U.S. Appl. No. 17/797,697, filed Aug. 4, 2022, Liu et al.
U.S. Appl. No. 17/921,971, filed Oct. 27, 2022, Liu et al.
U.S. Appl. No. 17/219,635, filed Mar. 31, 2021, Liu et al.
U.S. Appl. No. 18/064,738, filed Dec. 12, 2022, Liu et al.
U.S. Appl. No. 17/219,672, filed Mar. 31, 2021, Liu et al.
U.S. Appl. No. 17/751,599, filed May 23, 2022, Liu et al.
U.S. Appl. No. 17/440,682, filed Sep. 17, 2021, Liu et al.
U.S. Appl. No. 18/028,183, filed Mar. 23, 2023, Liu et al.
U.S. Appl. No. 14/234,031, filed Mar. 24, 2014, Liu et al.
U.S. Appl. No. 14/320,271, filed Jun. 30, 2014, Liu et al.
U.S. Appl. No. 16/441,751, filed Jun. 14, 2019, Liu et al.
U.S. Appl. No. 14/320,519, filed Jun. 30, 2014, Liu et al.
U.S. Appl. No. 14/913,458, filed Feb. 22, 2016, Liu et al.
U.S. Appl. No. 16/266,937, filed Feb. 4, 2019, Liu et al.
U.S. Appl. No. 14/320,370, filed Jun. 30, 2014, Liu et al.
U.S. Appl. No. 14/320,413, filed Jun. 30, 2014, Liu et al.
U.S. Appl. No. 14/874,123, filed Oct. 2, 2015, Liu et al.
U.S. Appl. No. 14/911,117, filed Feb. 9, 2016, Liu et al.
U.S. Appl. No. 17/160,329, filed Jan. 27, 2021, Liu et al.
U.S. Appl. No. 15/029,602, filed Apr. 14, 2016, Ritter et al.
U.S. Appl. No. 14/462,163, filed Aug. 18, 2014, Liu et al.
U.S. Appl. No. 14/462,189, filed Aug. 18, 2014, Liu et al.
U.S. Appl. No. 14/916,679, filed Mar. 4, 2016, Liu et al.
U.S. Appl. No. 16/860,639, filed Apr. 28, 2020, Liu et al.
U.S. Appl. No. 14/320,498, filed Jun. 30, 2014, Liu et al.
U.S. Appl. No. 14/320,467, filed Jun. 30, 2014, Liu et al.
U.S. Appl. No. 14/916,681, filed Mar. 4, 2016, Liu et al.
U.S. Appl. No. 17/103,233, filed Nov. 24, 2020, Liu et al.
U.S. Appl. No. 17/937,203, filed Sep. 30, 2022, Liu et al.
U.S. Appl. No. 14/326,329, filed Jul. 8, 2014, Liu et al.
U.S. Appl. No. 14/326,340, filed Jul. 8, 2014, Liu et al.
U.S. Appl. No. 14/326,361, filed Jul. 8, 2014, Liu et al.
U.S. Appl. No. 14/916,683, filed Mar. 4, 2016, Liu et al.
U.S. Appl. No. 16/796,323, filed Feb. 20, 2020, Liu et al.
U.S. Appl. No. 17/688,416, filed Mar. 7, 2022, Liu et al.
U.S. Appl. No. 14/325,815, filed Jul. 8, 2014, Liu et al.
U.S. Appl. No. 14/326,109, filed Jul. 8, 2014, Liu et al.
U.S. Appl. No. 14/326,140, filed Jul. 8, 2014, Liu et al.
U.S. Appl. No. 14/326,269, filed Jul. 8, 2014, Liu et al.
U.S. Appl. No. 14/326,290, filed Jul. 8, 2014, Liu et al.
U.S. Appl. No. 14/326,318, filed Jul. 8, 2014, Liu et al.
U.S. Appl. No. 14/326,303, filed Jul. 8, 2014, Liu et al.
U.S. Appl. No. 15/103,608, filed Jun. 10, 2016, Liu et al.
U.S. Appl. No. 16/374,634, filed Apr. 3, 2019, Liu et al.
U.S. Appl. No. 17/408,306, filed Aug. 20, 2021, Liu et al.
U.S. Appl. No. 15/329,925, filed Jan. 27, 2017, Liu et al.
U.S. Appl. No. 16/132,276, filed Sep. 14, 2018, Liu et al.
U.S. Appl. No. 16/888,646, filed May 29, 2020, Liu et al.
U.S. Appl. No. 18/069,898, filed Dec. 21, 2022, Liu et al.
U.S. Appl. No. 14/529,010, filed Oct. 30, 2014, Liu et al.
U.S. Appl. No. 15/958,721, filed Apr. 20, 2018, Liu et al.
U.S. Appl. No. 17/130,812, filed Dec. 22, 2020, Liu et al.
U.S. Appl. No. 15/331,852, filed Oct. 22, 2016, Liu et al.
U.S. Appl. No. 15/960,171, filed Apr. 23, 2018, Liu et al.
U.S. Appl. No. 17/527,011, filed Nov. 15, 2021, Liu et al.
U.S. Appl. No. 15/770,076, filed Apr. 20, 2018, Liu et al.
U.S. Appl. No. 16/327,744, filed Feb. 22, 2019, Maianti et al.
U.S. Appl. No. 18/055,274, filed Nov. 14, 2022, Maianti et al.
U.S. Appl. No. 15/852,891, filed Dec. 22, 2017, Maianti et al.
U.S. Appl. No. 16/926,436, filed Jul. 10, 2020, Maianti et al.
U.S. Appl. No. 15/852,526, filed Dec. 22, 2017, Maianti et al.
U.S. Appl. No. 16/492,534, filed Sep. 9, 2019, Liu et al.
U.S. Appl. No. 16/324,476, filed Feb. 8, 2019, Liu et al.
U.S. Appl. No. 15/791,085, filed Oct. 23, 2017, Liu et al.
U.S. Appl. No. 16/143,370, filed Sep. 26, 2018, Liu et al.
U.S. Appl. No. 17/148,059, filed Jan. 13, 2021, Liu et al.
U.S. Appl. No. 15/784,033, filed Oct. 13, 2017, Liu et al.
U.S. Appl. No. 17/692,925, filed Mar. 11, 2022, Liu et al.
U.S. Appl. No. 16/492,533, filed Sep. 9, 2019, Liu et al.
U.S. Appl. No. 18/059,308, filed Nov. 28, 2022, Liu et al.
U.S. Appl. No. 15/934,945, filed Mar. 23, 2018, Liu et al.
U.S. Appl. No. 17/586,688, filed Jan. 27, 2022, Liu et al.
U.S. Appl. No. 18/066,878, filed Dec. 15, 2022, Liu et al.
U.S. Appl. No. 16/643,376, filed Feb. 28, 2020, Liu et al.
U.S. Appl. No. 17/700,109, filed Mar. 21, 2022, Liu et al.
U.S. Appl. No. 16/612,988, filed Nov. 12, 2019, Liu et al.
U.S. Appl. No. 16/634,405, filed Jan. 27, 2020, Liu et al.
U.S. Appl. No. 18/178,048, filed Mar. 3, 2023, Liu et al.
U.S. Appl. No. 16/976,047, filed Aug. 26, 2020, Liu et al.
U.S. Appl. No. 17/593,020, filed Sep. 3, 2021, Church et al.

* cited by examiner

Examples of C→T transformations using *S. pyogenes* Cas9 Base Editor SpBE4 to introduce premature STOPs in the mouse gene mSCN9a Examples of C→T transformations using S. aureus Cas9 Base Editor KKH-SaBE3 to introduce premature STOPs in the mouse gene mSCN9a Summary of C→T and indel genome editing demonstrated herein using Base Editors targeted to the mouse gene mSCN9a

| Guide | Base Editor | Strand | Exon | mSCN9a mutation | Protospacer sequence | PAM | Editing Activity | Indel (%) | Trials | Specificity score | Predicted off-targets (0-1-2-3-4 mismatches) |
|---|---|---|---|---|---|---|---|---|---|---|---|
| g102 | SpBE3 | Re | 5 | W188X | GCCAGUUCCAAGGGUCACGG | AGG | 18.8% | 2.4% | n = 2 | 86 | 0 - 1 - 2 - 6 - 7 - 70 |
| g102 | SpBE4 | Re | 5 | W188X | GCCAGUUCCAAGGGUCACGG | AGG | 54.7% | 1.3% | n = 2 | 86 | 0 - 0 - 6 - 7 - 70 |
| g102 | VRQR-SpBE4 | Re | 5 | W188X | GCCAGUUCCAAGGGUCACGG | AGGA | 24.5% | 1.5% | n = 2 | 86 | 0 - 0 - 6 - 7 - 70 |
| g103 | SpBE4 | Re | 5 | W188X | GUUCCAAGGGUCACGGAGGA | AGG | 50.4% | 0.7% | n = 2 | 81 | 0 - 0 - 3 - 12 - 120 |
| g128 | KKH-SaBE3 | Re | 5 | W188X | CCAGUUCCAAGGGUCACGGAG GAAGGT | | 39.8% | 2.3% | n = 2 | 90 | 0 - 0 - 1 - 3 - 20 |
| g104 | SpBE3 | Re | 7 | intron junction | UUAGUCcttaaaatgtaggg | ggg | 14.8% | 1.5% | n = 1 | 77 | 0 - 0 - 7 - 7 - 105 |
| g107 | SpBE4 | Re | 17 | intron junction | GUUCAGGACctatatcaggg | tgg | 28.6% | 0.1% | n = 2 | 88 | 0 - 0 - 0 - 6 - 72 |
| g111 | SpBE4 | Fw | 27 | R1608X | CCUGUUCCGAGUCAUUCGCC | TGG | 40.9% | 2.2% | n = 2 | 63 | 0 - 3 - 1 - 1 - 46 |
| g131 | KKH-SaBE3 | Re | 26 | W1576X | UGUUCCAUCCCACAGUGAAGU | AGTAAT | 11.3% | 1.3% | n = 2 | 79 | 0 - 0 - 0 - 8 - 72 |
| g132 | KKH-SaBE3 | Re | 26 | W1576X | AAAUGUUCCAUCCCACAGUGA | AGTAGT | 7.7% | 0.5% | n = 1 | 77 | 0 - 0 - 1 - 5 - 81 |
| vgefa | SpBE3 | (reference gene control) | | | GACCCCCUCCACCCCGCCUC | CGG | 46.6% | 26.3% | n = 2 | n.d. | n.d. |
| vgefa | SpBE4 | (reference gene control) | | | GACCCCCUCCACCCCGCCUC | CGG | 88.2% | 3.5% | n = 2 | n.d. | n.d. |

Figure 5A

Examples of genome editing using *S. pyogenes* Cas9 in the mouse gene mSCN9a

| Guide | Strand | Res. | Exon | Protospacer sequence | PAM | Specificity score | Efficiency score | Predicted off-targets (0-1-2-3-4 mismatches) | Indel (%) |
|---|---|---|---|---|---|---|---|---|---|
| g10 | Fw | 404 | 10 | UGUGGUAGCCAUGGCGUACG | AGG | 95 | 52 | 0-0-1-4-45 | 22.0 |
| g1 | Fw | 485 | 11 | ACAGAAGCUGUCCAGUGGCG | AGG | 79 | 65 | 0-0-1-6-247 | 20.5 |
| g3 | Fw | 450 | 11 | CUGAGUACACGAGUUUAGGG | CGG | 83 | 69 | 0-0-1-8-51 | 33.4 |
| g4 | Fw | 515 | 11 | GAAAAGCUUCCAUCUCGGCG | TGG | 92 | 70 | 0-0-0-8-69 | 22.3 |
| g12 | Re | 516 | 11 | GGUGCCCUUCCACGCCGAGA | TGG | 97 | 55 | 0-0-0-1-22 | 16.6 |
| g5 | Fw | 713 | 14 | UGAGCAAAUCUGUACCACCA | TGG | 69 | 74 | 0-0-1-16-165 | 49.5 |
| g2 | Fw | 1041 | 17 | UAUCUCAAACCGUACCCUUG | CGG | 94 | 67 | 0-0-0-3-30 | 26.4 |
| g8 | Fw | 1025 | 17 | CAAGGACACAAAACGAACAG | CGG | 83 | 69 | 0-0-1-16-198 | 45.0 |
| g11 | Fw | 1312 | 22 | GUAGUGGUCAACGCACUCAU | AGG | 94 | 50 | 0-0-0-1-28 | 20.3 |
| vegfa | - | - | - | GACCCCCUCCACCCCGCCUC | CGG | - | - | (reference gene control) | 26.2 |

Figure 6A

SUPPRESSION OF PAIN BY GENE EDITING

RELATED APPLICATIONS

The present application is a national stage filing under 35 U.S.C. § 371 of international PCT application, PCT/US2018/021664, filed Mar. 9, 2018, which claims priority under 35 U.S.C. § 119(e) to U.S. provisional application, U.S. Ser. No. 62/469,408, filed Mar. 9, 2017, each of which is incorporated herein by reference.

GOVERNMENT SUPPORT

This invention was made with government support under GM065865 awarded by National Institutes of Health (NIH). The government has certain rights in this invention.

REFERENCE TO A SEQUENCE LISTING SUBMITTED AS A TEXT FILE VIA EFS-WEB

This application contains a Sequence Listing which has been submitted in ASCII format via EFS-Web and is hereby incorporated by reference in its entirety. Said ASCII copy, created on Jul. 17, 2023, is named H082470245US02-SUBSEQ-AZW and is 4,153,363 bytes in size.

BACKGROUND OF THE INVENTION

Long-term chronic pain due to trauma and associated with advanced cancer as well as other causes remains an unmet medical need. Management of pain using painkillers is inherently limited by the development of tolerance, physiological dependence, progressive addiction, and potential for overdose. Current health care policies in response to the massive demand for painkillers have led to extensive prescription of opioids, inadvertently contributing to broader public challenges associated with substance abuse and drug-related crime. Fundamentally, there is a pressing need for an innovative solution to address chronic pain that is non-addictive, generalizable, and/or permanent.

SUMMARY OF THE INVENTION

Described herein are systems, compositions, kits, and methods for the suppression of pain (e.g., chronic pain). The strategies rely, at least in part, on the targeted editing of genes encoding proteins (e.g., ion channels such as Nav1.7 encoded by the SCN9A gene) responsible for the propagation of pain signals in sensory neurons that display dysregulated excitability, e.g., in dorsal root ganglia (DRG) neurons. The targeted genome editing may be achieved, in some embodiments, using a genome editing agent, e.g., a nucleobase editor comprising a catalytically inactive Cas9 or a Cas9 nickase and a cytosine deaminase. The nucleobase editor introduces cytosine (C) to thymine (T) mutations in the targeted gene. In some embodiments, loss-of-function ion channel mutants are generated, leading to pain suppression. In some embodiments, the genome editing agent is administered locally to the site of pain. The pain suppression strategies provided herein are effective in long-term pain suppression and have high safety profiles. In some embodiments, neurotropic viral delivery vectors are used to specifically deliver the genome editing agent to neurons. In some embodiments, neuron-specific promoters are used to drive the expression of the genome editing agents specifically in neurons.

Some aspects of the present disclosure provide methods of editing a polynucleotide encoding an ion channel in a dorsal root ganglia (DRG) neuron, the method comprising contacting the ion channel-encoding polynucleotide with: (i) a fusion protein comprising: (a) a guide nucleotide sequence-programmable DNA binding protein domain; and (b) a cytosine deaminase domain; and (ii) a guide nucleotide sequence targeting the fusion protein of (i) to a target cytosine (C) base in the ion channel-encoding polynucleotide, whereby the contacting results in deamination of the target C base by the fusion protein, resulting in a cytosine (C) to thymine (T) change in the ion channel-encoding polynucleotide. In some embodiments, the guide nucleotide sequence-programmable DNA binding protein domain is selected from the group consisting of: nuclease inactive Cas9 (dCas9) domains, nuclease inactive Cpf1 domains, nuclease inactive Argonaute domains, and variants thereof.

In some embodiments, the guide nucleotide sequence-programmable DNA-binding protein domain is a nuclease inactive Cas9 (dCas9) domain. In some embodiments, the dCas9 domain is from *Streptococcus pyogenes*. In some embodiments, the amino acid sequence of the dCas9 domain includes mutations corresponding to a D10A and/or H840A mutation in SEQ ID NO: 1. In some embodiments, the amino acid sequence of the dCas9 domain includes a mutation corresponding to a D10A mutation in SEQ ID NO: 1, and wherein the dCas9 domain includes a histidine at the position corresponding to amino acid 840 of SEQ ID NO: 1. In some embodiments, the guide nucleotide sequence-programmable DNA-binding protein domain comprises a nuclease inactive Cpf1 (dCpf1) domain. In some embodiments, the dCpf1 domain is from a species of *Acidaminococcus* or Lachnospiraceae. In some embodiments, the guide nucleotide sequence-programmable DNA-binding protein domain comprises a nuclease inactive Argonaute (dAgo) domain. In some embodiments, the dAgo domain is from Natronobacterium gregoryi (dNgAgo).

In some embodiments, the cytosine deaminase domain comprises an apolipoprotein B mRNA-editing complex (APOBEC) family deaminase. In some embodiments, the cytosine deaminase is selected from the group consisting of APOBEC1, APOBEC2, APOBEC3A, APOBEC3B, APOBEC3C, APOBEC3D, APOBEC3F, APOBEC3G deaminase, APOBEC3H deaminase, APOBEC4 deaminase, activation-induced deaminase (AID), and pmCDA1. In some embodiments, the cytosine deaminase comprises the amino acid sequence of any one of SEQ ID NOs: 271-292 and 303.

In some embodiments, the fusion protein further comprises a uracil glycosylase inhibitor (UGI) domain. In some embodiments, the UGI domain comprises the amino acid sequence of SEQ ID NO: 304.

In some embodiments, the cytosine deaminase domain is fused to the N-terminus of the guide nucleotide sequence-programmable DNA-binding protein domain. In some embodiments, the UGI domain is fused to the C-terminus of the guide nucleotide sequence-programmable DNA-binding protein domain.

In some embodiments, the cytosine deaminase and the guide nucleotide sequence-programmable DNA-binding protein domain are fused via an optional linker. In some embodiments, the UGI domain is fused to the dCas9 domain via an optional linker.

In some embodiments, the fusion protein has the structure $NH_2$-[cytosine deaminase domain]-[optional linker sequence]-[guide nucleotide sequence-programmable DNA-binding protein domain]-[optional linker sequence]-[UGI domain]-COOH. In some embodiments, the fusion protein has the structure NH$_2$-[UGI domain]-[optional linker sequence]-[cytosine deaminase domain]-[optional linker sequence]-[guide nucleotide sequence-programmable DNA-binding protein domain]-COOH. In some embodiments, the fusion protein has the structure NH$_2$-[cytosine deaminase domain]-[optional linker sequence]-[guide nucleotide sequence-programmable DNA-binding protein domain]-COOH.

In some embodiments, the linker comprises (GGGS)$_n$ (SEQ ID NO: 2430), (GGGGS)$_n$ (SEQ ID NO: 308), (G)$_n$ (SEQ ID NO: 2498), (EAAAK)$_n$ (SEQ ID NO: 309), (GGS)$_n$(SEQ ID NO: 2467), SGSETPGTSESATPES (SEQ ID NO: 310), or (XP)$_n$ motif, or a combination of any of these, wherein n is independently an integer between 1 and 30, and wherein X is any amino acid. In some embodiments, the linker comprises the amino acid sequence SGSETPGTSESATPES (SEQ ID NO: 310). In some embodiments, the linker is (GGS)$_n$ (SEQ ID NO: 2467), and wherein n is 1, 3, or 7.

In some embodiments, the fusion protein comprises the amino acid sequence of any one of SEQ ID NO: 10, 293-302, and 2495.

In some embodiments, the polynucleotide encoding the ion channel comprises a coding strand and a complementary strand. In some embodiments, the polynucleotide encoding the ion channel comprises a coding region and a non-coding region. In some embodiments, the C to T change occurs in the coding region of the ion channel-encoding polynucleotide. In some embodiments, the C to T change leads to a mutation in the ion channel.

In some embodiments, the mutation introduces a premature stop codon in the ion channel-coding sequence that leads to a truncated or non-functional ion channel. In some embodiments, the premature stop codon is TAG (Amber), TGA (Opal), or TAA (Ochre). In some embodiments, the mutation destabilizes ion-channel protein folding. In some embodiments, the C to T change occurs at a C base-paired with the G base in a start codon (AUG).

In some embodiments, the C to T change occurs at the non-coding region of the ion channel-encoding polynucleotide. In some embodiments, the C to T change occurs at a splicing site in the non-coding region of the ion channel-encoding polynucleotide. In some embodiments, the C to T change occurs at an intron-exon junction. In some embodiments, the C to T change occurs at a splicing donor site. In some embodiments, the C to T change occurs at a splicing acceptor site.

In some embodiments, the ion channel is selected from the group consisting of: NaV1.7, NaV1.8, NaV1.9, NaV1.3, CaV3.2, HCN1, HCN2, and Ano1. In some embodiments, the ion channel is NaV1.7 encoded by the SCN9A gene.

In some embodiments, the mutation is a loss-of-function mutation. In some embodiments, the C to T change occurs in a target codon selected from Tables 2, 4, and 6. In some embodiments, the guide nucleotide sequence is selected from SEQ ID NOs: 339-1456.

In some embodiments, a PAM sequence is located 3' of the C being changed. In some embodiments, a PAM sequence is located 5' of the C being changed. In some embodiments, the PAM sequence is selected from the group consisting of: NGG, NGAN, NGNG, NGAG, NGCG, NNGRRT, NGGNG, NGRRN, NNNRRT, NNNGATT, NNAGAA, and NAAAC, wherein Y is pyrimidine, R is purine, and N is any nucleobase. In some embodiments, the PAM sequence is selected from the group consisting of: NNT, NNNT, and YNT, wherein Y is pyrimidine, and N is any nucleobase. In some embodiments, no PAM sequence is located 3' of the target C base. In some embodiments, no PAM sequence is located 5' of the target C base.

In some embodiments, at least 1, 2, 3, 4, 5, 6, 7, 8, 9, or 10 mutations are introduced into the ion channel-encoding polynucleotide. In some embodiments, the guide nucleotide sequence is RNA (gRNA). In some embodiments, the guide nucleotide sequence is ssDNA (gDNA).

In some embodiments, the DRG neuron is in a mammal. In some embodiments, the mammal is a rodent. In some embodiments, the rodent is a mouse. In some embodiments, the rodent is a rat. In some embodiments, the mammal is a human.

In some embodiments, a nucleic acid construct encoding the fusion protein is delivered to the DRG neuron via a neurotropic viral delivery vector. In some embodiments, the neurotropic viral delivery vector is derived from Herpesviridae, varicella zoster virus, pseudorabies virus, cyromegalovirus, Epstein-barr virus, encephalitis virus, polio virus, coxsackie virus, echo virus, mumps virus, measles virus, and rabies virus. In some embodiments, the neurotropic viral delivery vector is derived from Herpes Simplex Virus 1 (HSV-1). In some embodiments, the neurotropic viral delivery vector is derived from a recombinant adeno-associated virus (AAV).

Other aspects of the present disclosure provide compositions comprising: (i) a fusion protein comprising: (a) a guide nucleotide sequence-programmable DNA binding protein domain; and (b) a cytosine deaminase domain; and (ii) a guide nucleotide sequence targeting the fusion protein of (i) to a target cytosine (C) base in an ion channel-encoding polynucleotide.

Further provided herein are compositions comprising a neurotropic viral delivery vector comprising a nucleic acid encoding: (i) a fusion protein comprising: (a) a guide nucleotide sequence-programmable DNA binding protein domain; and (b) a cytosine deaminase domain; and (ii) a guide nucleotide sequence targeting the fusion protein of (i) to a target cytosine (C) base in an ion channel-encoding polynucleotide.

In some embodiments, the guide nucleotide sequence comprises the nucleotide sequence of any one of SEQ ID NOs: 339-1456, 1504-2425, and 2443-2445. In some embodiments, the composition further comprises a pharmaceutically acceptable carrier. Kits comprising the compositions described herein are also provided.

Other aspects of the present disclosure provide methods of suppressing pain, the method comprising administering to a subject in need thereof a therapeutically effective amount of the composition described herein.

In some embodiments, the pain is chronic pain. In some embodiments, the pain is selected from the group consisting of: neuropathic pain, allodynia, hyperalgesia, dysesthesia, causalgia, neuralgia, and arthralgia. In some embodiments, the pain is associated with cancer, tumor pressure, bone metastasis, chemotherapy peripheral neuropathy, radiculopathy (sciatica, lumbar, cervical, failed back surgery syndrome), piriformis syndrome, phantom pain, arachnoiditis, fibromyalgia, facet joint mediated pain, sympathetically-mediated pain syndrome such as complex regional pain syndromes (crps), sacroiliac (si) joint mediated pain, meralgia paresthetica, localized myofacial pain syndromes-myofacial trigger points, diffuse myofacial pain syndrome, post-herpetic neuralgia, trigeminal neuralgia, glossopharyngeal neuralgia, scar pain (post-epesiotomy, post-hernia repair, post-surgery, post-radiotherapy), vulvodynia, vaginismus, levator ani syndrome, chronic prostatitis, interstitial cystitis, first bite syndrome, rheumatoid arthritis pain, osteoarthritis pain, atypical odontalgia, phantom tooth pain, neuropathic orofacial pain, primary erythermalgia and atypical facial pain.

In some embodiments, the subject is a mammal. In some embodiments, the mammal is a rodent. In some embodiments, the rodent is a mouse. In some embodiments, the rodent is a rat. In some embodiments, the mammal is a human. In some embodiments, the mammal is a companion animal. In some embodiments, the companion animal is a dog, a cat, a horses, a cattle, a pig, a sheep, a goat, a chicken, a mouse, a rat, a guinea pig, or a hamster. In some embodiments, the composition is administered orally or parenterally.

The details of certain embodiments of the invention are set forth in the Detailed Description of Certain Embodiments, as described below. Other features, objects, and advantages of the invention will be apparent from the Definitions, Examples, Figures, and Claims.

BRIEF DESCRIPTION OF THE DRAWINGS

The accompanying drawings, which constitute a part of this specification, illustrate several embodiments of the invention and together with the description, serve to explain the principles of the invention.

FIG. 1A is a schematic representing a DRG neuron extending an axonal projection that expresses specialized ion channels for triggering and propagating action potentials (AP) in response to stimuli. The body of the neuron resides in a ganglion near the spinal cord together with thousands of other neurons. The output from the dendrites of this neuron inside the spinal cord involve the release of the neurotransmitters, such as glutamate and substance P, and become the pain signals propagated by the spinal cord that are interpreted as signals of pain by the brain. Adapted from Reference 1 in the "References" section. FIG. 1B is a schematic representing a programmable genome editing treatment with a localized neurotropic viral vector to deliver an expression construct into the axon, exploiting the retrograde transport mechanisms to the nucleus of a dorsal root ganglion (DRG) neuron to modify one of the specialized genes that mediate the threshold or transmission of action potentials that are interpreted as pain (Table 12). FIG. 1C is a schematic representing the outcome (green arrows) of programmable genome editing treatment with a topologically localized neurotropic viral vector, for example, targeting the NaV1.7/SCN9a gene.

FIG. 4A shows non-limiting examples of the results obtained from C→T base editing treatments using guide-RNAs targeted to the NaV1.7/SCN9A gene in the mouse Neuro-2a cell line, analysed using Illumina MiSeq high-throughput DNA sequencing. The treatments shown generate premature STOP codons or modify intron/exon junctions involved in mRNA splicing. FIG. 4B is a two-dimensional representation of the primary amino acid sequence of an isoform of mouse NaV1.7/SCN9A highlighting the sites targeted in panel A and other representative sites that can be targeted in the same manner (black). Additional possible modifications are not shown for clarity (see, e.g., FIG. 3).

FIGS. 5A-5B show representative plots obtained from C→T base editing treatments targeted to the NaV1.7/SCN9A gene in the mouse Neuro-2a cell line, analysed using Illumina MiSeq high-throughput DNA sequencing. FIG. 5A shows the *S. pyogenes* Cas9 DNA-binding domain fused to APOBEC and UGI (SpBE4), and FIG. 5B shows the KKH variant of the *S. aureus* Cas9 DNA-binding domain fused to APOBEC and UGI (KKH-SaBE3). The X axis sequence is underlined at the PAM and the end of the protospacer-targeting region is marked with a horizontal line. A dashed box highlights a target codon that is modified to a premature STOP codon by C to T base-editors acting on either the forward (coding) or reverse (template) strand of genomic DNA. The protospacer sequences in FIG. 5A correspond from top to bottom to SEQ ID NOs: 2447-2457, with 2457 repeated twice at the end.

FIGS. 6A-6C. FIG. 6A shows representative examples of the results obtained from active wild-type *S. pyogenes* Cas9 treatments using guide-RNAs targeted to the NaV1.7/SCN9A gene in the mouse Neuro-2a cell line, analysed using Illumina MiSeq high-throughput DNA sequencing. FIG. 6B is a gel electrophoresis analysis of PCR products following wild-type *S. pyogenes* Cas9 treatment using two or more guide-RNAs targeted to the NaV1.7/SCN9A gene in the mouse Neuro-2a cell line, which generate indels and longer deletions between the predicted target sites. The uncut genomic site (plus small indels) are seen as a high molecular-weight band, and large deletions are seen as the lower molecular-weight bands. FIG. 6C shows a representative analysis by Illumina MiSeq high-throughput DNA showing the large deletion product following wild-type *S. pyogenes* Cas9 treatment using two guide-RNAs, g3 and g12 from FIG. 6B, targeted to the NaV1.7/SCN9A gene in the mouse Neuro-2a cell line sequencing. The protospacer sequences in FIG. 6A correspond from top to bottom to SEQ ID NOs: 2458-2466 and 2457.

DEFINITIONS

Figure 1A:
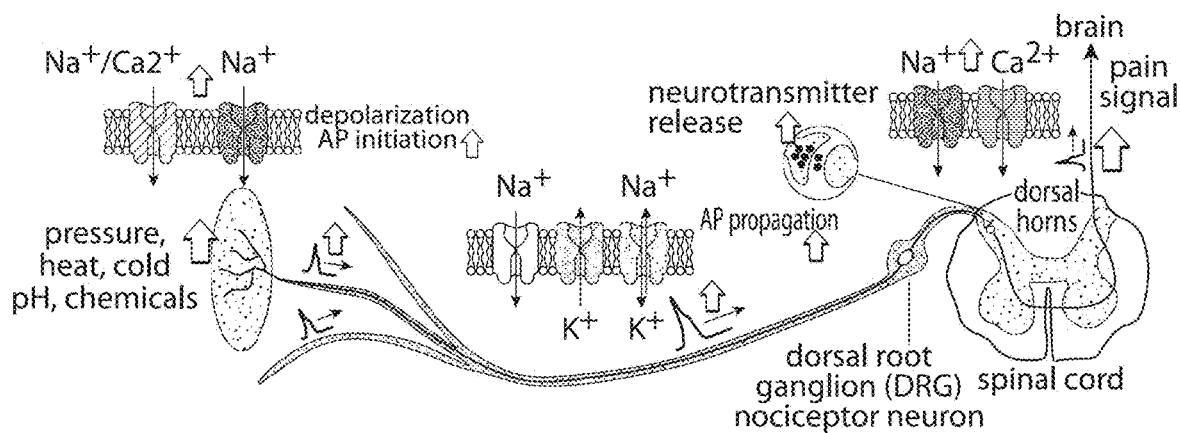
FIGS. 1A-1C show schematic representations of exemplary ion channels and signal transmission in doral root ganglion (DRG) neurons.

As used herein and in the claims, the singular forms "a," "an," and "the" include the singular and the plural reference unless the context clearly indicates otherwise. Thus, for example, a reference to "an agent" includes a single agent and a plurality of such agents.

A "dorsal root ganglion (DRG)," also referred to as a "spinal ganglion" or "posterior root ganglion," is a cluster of nerve cell bodies (a ganglion) in the posterior root of a spinal nerve. A neuron in the DRG is referred to herein as a "dorsal root ganglia (DRG) neuron." The dorsal root ganglia contain the cell bodies of sensory neurons.

A "neuron" is an electrically excitable cell that processes and transmits information through electrical and chemical signals. These signals between neurons occur via synapses, specialized connections with other cells. Neurons can connect to each other to form neural networks. Neurons are the core components of the brain and spinal cord of the central nervous system (CNS), and of the ganglia of the peripheral nervous system (PNS).

There are several types of specialized neurons: sensory neurons, motor neurons, and interneurons. A "sensory neuron" is a neuron that responds to stimuli such as touch, sound, or light, and all other stimuli affecting the cells of the sensory organs that then send signals to the spinal cord and brain. A "motor neuron" is a neuron that receives signals from the brain and spinal cord to cause muscle contractions and affect glandular outputs. A "interneuron" is a neuron that connects neurons to other neurons within the same region of the brain or spinal cord in neural networks.

In the PNS, an afferent nerve fiber is the axon of an afferent sensory neuron. It is a long process extending far from the nerve cell body that carries nerve impulses from sensory receptors or sense organs toward the central nervous system. The opposite direction of neural activity is termed efferent conduction.

Neurons are electrically excitable, maintaining voltage gradients across their membranes by means of metabolically driven ion pumps, which combine with ion channels embedded in the membrane to generate intracellular-versus-extracellular concentration differences of ions, such as sodium, potassium, chloride, and calcium. Changes in the cross-membrane voltage can alter the function of voltage-dependent ion channels. If the voltage changes by a large enough amount, an all-or-none electrochemical pulse called an action potential is generated, which travels rapidly along the cell's axon, and activates synaptic connections with other cells when it arrives.

An "ion channel" is a pore-forming membrane protein expressed on the surface of a cell (e.g., a DRG neuron). Ion channels on the surface of a cell (e.g., a DRG neuron) have various biological functions including: establishing a resting membrane potential, shaping action potentials and other electrical signals by gating the flow of ions across the cell membrane, controlling the flow of ions across secretory and epithelial cells, and regulating cell volume. Activated transmembrane ion channels allow ions into or out of cells. Genes encoding ion channels in DRG neurons that are responsible for propagation of pain are provided in Example 2.

"Hyperalgesia" is an increased sensitivity to pain, which may be caused by damage to nociceptors or peripheral nerves. Temporary increased sensitivity to pain also occurs as part of sickness behavior, the evolved response to infection. Long-term opioid (e.g. heroin, morphine) users and those on high-dose opioid medications for the treatment of chronic pain may experience hyperalgesia and experience pain out of proportion to physical findings, which is a common cause for loss of efficacy of these medications over time.

"Allodynia" refers to central pain sensitization (increased response of neurons) following normally non-painful, often repetitive, stimulation. Allodynia can lead to the triggering of a pain response from stimuli which do not normally provoke pain. Temperature or physical stimuli can provoke allodynia, which may feel like a burning sensation. Allodynia often occurs after injury to a site. Allodynia is different from hyperalgesia, an extreme, exaggerated reaction to a stimulus which is normally painful.

The term "loss-of-function mutation" or "inactivating mutation" refers to a mutation that results in the gene product having less or no function (being partially or wholly inactivated). When the allele has a complete loss of function (null allele), it is often called an amorphic mutation in the Muller's morphs schema. Phenotypes associated with such mutations are most often recessive. Exceptions are when the organism is haploid, or when the reduced dosage of a normal gene product is not enough for a normal phenotype (this is called haploinsufficiency).

The term "gain-of-function mutation" or "activating mutation" refers to a mutation that changes the gene product such that its effect gets stronger (enhanced activation) or even is superseded by a different and abnormal function. A gain of function mutation may also be referred to as a neomorphic mutation. When the new allele is created, a heterozygote containing the newly created allele as well as the original will express the new allele, genetically defining the mutations as dominant phenotypes.

The term "genome" refers to the genetic material of a cell or organism. It typically includes DNA (or RNA in the case of RNA viruses). The genome includes both the genes, the coding regions, the noncoding DNA, and the genomes of the mitochondria and chloroplasts. A genome does not typically include genetic material that is artificially introduced into a cell or organism, e.g., a plasmid that is transformed into a bacteria is not a part of the bacterial genome.

A "programmable DNA-binding protein" refers to DNA binding proteins that can be programmed to target to any desired nucleotide sequence within a genome. To program the DNA-binding protein to bind a desired nucleotide sequence, the DNA binding protein may be modified to change its binding specificity, e.g., zinc finger DNA-binding domain, zinc finger nuclease (ZFN), or transcription activator-like effector proteins (TALE). ZFNs are artificial restriction enzymes generated by fusing a zinc finger DNA-binding domain to a DNA-cleavage domain. Zinc finger domains can be engineered to target specific desired DNA sequences, and this enables zinc-fingers to bind unique sequences within complex genomes. Transcription activator-like effector nucleases (TALEN) are engineered restriction enzymes that can be engineered to cut specific sequences of DNA. They are made by fusing a TAL effector DNA-binding domain to a nuclease domain (e.g. Fok1). Transcription activator-like effectors (TALEs) can be engineered to bind practically any desired DNA sequence. Methods for programming ZFNs and TALEs are familiar to one skilled in the art. For example, such methods are described in Maeder et al., *Mol. Cell* 31 (2): 294-301, 2008; Carroll et al., *Genetics Society of America*, 188 (4): 773-782, 2011; Miller et al., *Nature Biotechnology* 25 (7): 778-785, 2007; Christian et al., *Genetics* 186 (2): 757-61, 2008; Li et al., *Nucleic Acids Res.* 39 (1): 359-372, 2010; and Moscou et al., *Science* 326 (5959): 1501, 2009, each of which are incorporated herein by reference.

A "guide nucleotide sequence-programmable DNA-binding protein" refers to a protein, a polypeptide, or a domain that is able to bind DNA, and the binding to its target DNA sequence is mediated by a guide nucleotide sequence. Thus, it is appreciated that the guide nucleotide sequence-programmable DNA-binding protein binds a guide nucleotide sequence. The "guide nucleotide" may be an RNA or DNA molecule (e.g., a single-stranded DNA or ssDNA molecule) that is complementary to the target sequence and can guide the DNA binding protein to the target sequence. As such, a guide nucleotide sequence-programmable DNA-binding protein may be a RNA-programmable DNA-binding protein (e.g., a Cas9 protein), or an ssDNA-programmable DNA-binding protein (e.g., an Argonaute protein). "Programmable" means the DNA-binding protein may be programmed to bind any DNA sequence that the guide nucleotide targets.

In some embodiments, the guide nucleotide sequence exists as a single nucleotide molecule and comprises two domains: (1) a domain that shares homology to a target nucleic acid (e.g., and directs binding of a guide nucleotide sequence-programmable DNA-binding protein to the target); and (2) a domain that binds a guide nucleotide sequence-programmable DNA-binding protein. In some embodiments, domain (2) corresponds to a sequence known as a tracrRNA and comprises a stem-loop structure. For example, in some embodiments, domain (2) is identical or homologous to a tracrRNA as provided in Jinek et al., *Science* 337:816-821(2012), which is incorporated herein by reference. Other examples of gRNAs (e.g., those including domain 2) can be found in U.S. Patent Application Publication US 2016/0208288 and U.S. Patent Application Publication US 2016/0200779, each of which is incorporated herein by reference.

Because the guide nucleotide sequence hybridizes to a target DNA sequence, the guide nucleotide sequence-programmable DNA-binding proteins are able to specifically bind, in principle, to any sequence complementary to the guide nucleotide sequence. Methods of using guide nucleotide sequence-programmable DNA-binding protein, such as Cas9, for site-specific editing of the genome (with or without cleaving the double stranded DNA) are known in the art (see e.g., Cong, L. et al. Multiplex genome engineering using CRISPR/Cas systems. *Science* 339, 819-823 (2013); Mali, P. et al. RNA-guided human genome engineering via Cas9. *Science* 339, 823-826 (2013); Hwang, W. Y. et al. Efficient genome editing in zebrafish using a CRISPR-Cas system. *Nature Biotechnology* 31, 227-229 (2013); Jinek, M. et al. RNA-programmed genome editing in human cells. *eLife* 2, e00471 (2013); Dicarlo, J. E. et al. Genome engineering in *Saccharomyces cerevisiae* using CRISPR-Cas systems. *Nucleic Acids Research* (2013); Jiang, W. et al. RNA-guided editing of bacterial genomes using CRISPR-Cas systems. *Nature Biotechnology* 31, 233-239 (2013); each of which is incorporated herein by reference).

As used herein, the term "Cas9" or "Cas9 nuclease" refers to an RNA-guided nuclease comprising a Cas9 protein, a fragment, or a variant thereof. A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc), and a Cas9 protein. The tracrRNA serves as a guide for ribonuclease 3-aided processing of pre-crRNA. Subsequently, Cas9/crRNA/tracrRNA endonucleolytically cleaves a linear or circular dsDNA target complementary to the spacer. The target strand not complementary to the crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek et al., *Science* 337:816-821(2012), which is incorporated herein by reference.

Cas9 nuclease sequences and structures are well known to those of skill in the art (see, e.g., Ferretti et al., *Proc. Natl. Acad. Sci.* 98:4658-4663(2001); Deltcheva E. et al., *Nature* 471:602-607(2011); and Jinek et al., *Science* 337:816-821 (2012), each of which is incorporated herein by reference). Cas9 orthologs have been described in various species. Additional suitable Cas9 nucleases and sequences will be apparent to those of skill in the art based on this disclosure, and such Cas9 nucleases and sequences include Cas9 sequences from the organisms and loci disclosed in Chylinski et al., (2013) RNA Biology 10:5, 726-737; which are incorporated herein by reference. In some embodiments, wild type Cas9 corresponds to Cas9 from *Streptococcus pyogenes* (NCBI Reference Sequence: NC_002737.2, SEQ ID NO: 5 (nucleotide); and Uniport Reference Sequence: Q99ZW2, SEQ ID NO: 1 (amino acid).

(SEQ ID NO: 5)

```
ATGGATAAGAAATACTCAATAGGCTTAGATATCGGCACAAATAGCGTCGGATGGGCGGTGATCAC

TGATGAATATAAGGTTCCGTCTAAAAAGTTCAAGGTTCTGGGAAATACAGACCGCCACAGTATCA

AAAAAAATCTTATAGGGGCTCTTTTATTTGACAGTGGAGAGACAGCGGAAGCGACTCGTCTCAAA

CGGACAGCTCGTAGAAGGTATACACGTCGGAAGAATCGTATTTGTTATCTACAGGAGATTTTTCA

AATGAGATGGCGAAAGTAGATGATAGTTTCTTTCATCGACTTGAAGAGTCTTTTTTGGTGGAAGAA

GACAAGAAGCATGAACGTCATCCTATTTTTGGAAATATAGTAGATGAAGTTGCTTATCATGAGAAA

TATCCAACTATCTATCATCTGCGAAAAAAATTGGTAGATTCTACTGATAAAGCGGATTTGCGCTTA

ATCTATTTGGCCTTAGCGCATATGATTAAGTTTCGTGGTCATTTTTTGATTGAGGGAGATTTAAATC

CTGATAATAGTGATGTGGACAAACTATTTATCCAGTTGGTACAAACCTACAATCAATTATTTGAAG

AAAACCCTATTAACGCAAGTGGAGTAGATGCTAAAGCGATTCTTTCTGCACGATTGAGTAAATCAA

GACGATTAGAAAATCTCATTGCTCAGCTCCCCGGTGAGAAGAAAAATGGCTTATTTGGGAATCTCA

TTGCTTTGTCATTGGGTTTGACCCCTAATTTTAAATCAAATTTTGATTTGGCAGAAGATGCTAAATT

ACAGCTTTCAAAAGATACTTACGATGATGATTTAGATAATTTATTGGCGCAAATTGGAGATCAATA

TGCTGATTTGTTTTTGGCAGCTAAGAATTTATCAGATGCTATTTTACTTTCAGATATCCTAAGAGTA

AATACTGAAATAACTAAGGCTCCCCTATCAGCTTCAATGATTAAACGCTACGATGAACATCATCAA
```

-continued

```
GACTTGACTCTTTTAAAAGCTTTAGTTCGACAACAACTTCCAGAAAAGTATAAAGAAATCTTTTTT
GATCAATCAAAAAACGGATATGCAGGTTATATTGATGGGGGAGCTAGCCAAGAAGAATTTTATAA
ATTTATCAAACCAATTTTAGAAAAAATGGATGGTACTGAGGAATTATTGGTGAAACTAAATCGTGA
AGATTTGCTGCGCAAGCAACGGACCTTTGACAACGGCTCTATTCCCCATCAAATTCACTTGGGTGA
GCTGCATGCTATTTTGAGAAGACAAGAAGACTTTTATCCATTTTTAAAAGACAATCGTGAGAAGAT
TGAAAAAATCTTGACTTTTCGAATTCCTTATTATGTTGGTCCATTGGCGCGTGGCAATAGTCGTTTT
GCATGGATGACTCGGAAGTCTGAAGAAACAATTACCCCATGGAATTTTGAAGAAGTTGTCGATAA
AGGTGCTTCAGCTCAATCATTTATTGAACGCATGACAAACTTTGATAAAAATCTTCCAAATGAAAA
AGTACTACCAAAACATAGTTTGCTTTATGAGTATTTTACGGTTTATAACGAATTGACAAAGGTCAA
ATATGTTACTGAAGGAATGCGAAAACCAGCATTTCTTTCAGGTGAACAGAAGAAAGCCATTGTTG
ATTTACTCTTCAAAACAAATCGAAAAGTAACCGTTAAGCAATTAAAAGAAGATTATTTCAAAAAA
ATAGAATGTTTTGATAGTGTTGAAATTTCAGGAGTTGAAGATAGATTTAATGCTTCATTAGGTACC
TACCATGATTTGCTAAAAATTATTAAAGATAAAGATTTTTTGGATAATGAAGAAAATGAAGATATC
TTAGAGGATATTGTTTTAACATTGACCTTATTTGAAGATAGGGAGATGATTGAGGAAAGACTTAAA
ACATATGCTCACCTCTTTGATGATAAGGTGATGAAACAGCTTAAACGTCGCCGTTATACTGGTTGG
GGACGTTTGTCTCGAAAATTGATTAATGGTATTAGGGATAAGCAATCTGGCAAAACAATATTAGAT
TTTTTGAAATCAGATGGTTTTGCCAATCGCAATTTTATGCAGCTGATCCATGATGATAGTTTGACAT
TTAAAGAAGACATTCAAAAAGCACAAGTGTCTGGACAAGGCGATAGTTTACATGAACATATTGCA
AATTTAGCTGGTAGCCCTGCTATTAAAAAAGGTATTTTACAGACTGTAAAAGTTGTTGATGAATTG
GTCAAAGTAATGGGGCGGCATAAGCCAGAAAATATCGTTATTGAAATGGCACGTGAAAATCAGAC
AACTCAAAAGGGCCAGAAAAATTCGCGAGAGCGTATGAAACGAATCGAAGAAGGTATCAAAGAA
TTAGGAAGTCAGATTCTTAAAGAGCATCCTGTTGAAAATACTCAATTGCAAAATGAAAAGCTCTAT
CTCTATTATCTCCAAAATGGAAGAGACATGTATGTGGACCAAGAATTAGATATTAATCGTTTAAGT
GATTATGATGTCGATCACATTGTTCCACAAAGTTTCCTTAAAGACGATTCAATAGACAATAAGGTC
TTAACGCGTTCTGATAAAAATCGTGGTAAATCGGATAACGTTCCAAGTGAAGAAGTAGTCAAAAA
GATGAAAAACTATTGGAGACAACTTCTAAACGCCAAGTTAATCACTCAACGTAAGTTTGATAATTT
AACGAAAGCTGAACGTGGAGGTTTGAGTGAACTTGATAAAGCTGGTTTTATCAAACGCCAATTGG
TTGAAACTCGCCAAATCACTAAGCATGTGGCACAAATTTTGGATAGTCGCATGAATACTAAATACG
ATGAAAATGATAAACTTATTCGAGAGGTTAAAGTGATTACCTTAAAATCTAAATTAGTTTCTGACT
TCCGAAAAGATTTCCAATTCTATAAAGTACGTGAGATTAACAATTACCATCATGCCCATGATGCGT
ATCTAAATGCCGTCGTTGGAACTGCTTTGATTAAGAAATATCCAAAACTTGAATCGGAGTTTGTCT
ATGGTGATTATAAAGTTTATGATGTTCGTAAAATGATTGCTAAGTCTGAGCAAGAAATAGGCAAA
GCAACCGCAAAATATTTCTTTTACTCTAATATCATGAACTTCTTCAAAACAGAAATTACACTTGCA
AATGGAGAGATTCGCAAACGCCCTCTAATCGAAACTAATGGGGAAACTGGAGAAATTGTCTGGGA
TAAAGGGCGAGATTTTGCCACAGTGCGCAAAGTATTGTCCATGCCCCAAGTCAATATTGTCAAGAA
AACAGAAGTACAGACAGGCGGATTCTCCAAGGAGTCAATTTTACCAAAAAGAAATTCGGACAAGC
TTATTGCTCGTAAAAAAGACTGGGATCCAAAAAAATATGGTGGTTTTGATAGTCCAACGGTAGCTT
ATTCAGTCCTAGTGGTTGCTAAGGTGGAAAAAGGGAAATCGAAGAAGTTAAAATCCGTTAAAGAG
TTACTAGGGATCACAATTATGGAAAGAAGTTCCTTTGAAAAAAATCCGATTGACTTTTTAGAAGCT
AAAGGATATAAGGAAGTTAAAAAAGACTTAATCATTAAACTACCTAAATATAGTCTTTTTGAGTTA
```

-continued

```
GAAAACGGTCGTAAACGGATGCTGGCTAGTGCCGGAGAATTACAAAAAGGAAATGAGCTGGCTCT

GCCAAGCAAATATGTGAATTTTTTATATTTAGCTAGTCATTATGAAAAGTTGAAGGGTAGTCCAGA

AGATAACGAACAAAAACAATTGTTTGTGGAGCAGCATAAGCATTATTTAGATGAGATTATTGAGC

AAATCAGTGAATTTTCTAAGCGTGTTATTTTAGCAGATGCCAATTTAGATAAAGTTCTTAGTGCAT

ATAACAAACATAGAGACAAACCAATACGTGAACAAGCAGAAAATATTATTCATTTATTTACGTTG

ACGAATCTTGGAGCTCCCGCTGCTTTTAAATATTTTGATACAACAATTGATCGTAAACGATATACG

TCTACAAAAGAAGTTTTAGATGCCACTCTTATCCATCAATCCATCACTGGTCTTTATGAAACACGC

ATTGATTTGAGTCAGCTAGGAGGTGACTGA
```

(SEQ ID NO: 1)

```
MDKKYSIGLDIGTNSVGWAVITDEYKVPSKKFKVLGNTDRHSIKKNLIGALLFDSGETAEATRLKRTARR

RYTRRKNRICYLQEIFSNEMAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLLKALVRQQLPEK

YKEIFFDQSKNGYAGYIDGGASQLEFYKFIKPILEKMDGTEELLVKLNREDLLRKQRTFDNGSIPHQIH

LGELHAILRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKKAIVDLLF

KTNRKVTVKQLKEDYFKKIECFDSVEISGVEDRFNASLGTYHDLLKIIKDKDFLDNEENEDILEDIVLT

LTLFEDREMIEERLKTYAHLFDDKVMKQLKRRRYTGWGRLSRKLINGIRDKQSGKTILDFLKSDGFANR

NFMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEKGKSKKLKSVKELLGITIME

RSSFEKNPIDFLEAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKHRDKPIREQAEN

IIHLFTLTNLGAPAAFKYFDTTIDRKRYTSTKEVLDATLIHQSITGLYETRIDLSQLGGD
```

(single underline: HNH domain; double underline: RuvC domain)

In some embodiments, wild type Cas9 corresponds to Cas9 from *Streptococcus Aureus*. *S. aureus* Cas9 wild type (SEQ ID NO: 6)

```
MKRNYILGLDIGITSVGYGIIDYETRDVIDAGVRLFKEANVENNE

GRRSKRGARRLKRRRRHRIQRVKKLLFDYNLLTDHSELSGINPYE

ARVKGLSQKLSEEEFSAALLHLAKRRGVHNVNEVEEDTGNELSTK

EQISRNSKALEEKYVAELQLERLKKDGEVRGSINRFKTSDYVKEA

KQLLKVQKAYHQLDQSFIDTYIDLLETRRTYYEGPGEGSPFGWKD

IKEWYEMLMGHCTYFPEELRSVKYAYNADLYNALNDLNNLVITRD

ENEKLEYYEKFQIIENVFKQKKKPTLKQIAKEILVNEEDIKGYRV

TSTGKPEFTNLKVYHDIKDITARKEIIENAELLDQIAKILTIYQS

SEDIQEELTNLNSELTQLEIEQISNLKGYTGTHNLSLKAINLILD

ELWHTNDNQIAIFNRLKLVPKKVDLSQQKEIPTTLVDDFILSPVV

KRSFIQSIKVINAIIKKYGLPNDIIIELAREKNSKDAQKMINEMQ

KRNRQTNERIEEIIRTTGKENAKYLIEKIKLHDMQEGKCLYSLEA

IPLEDLLNNPFNYEVDHIIPRSVSFDNSFNNKVLVKQEENSKKGN

RTPFQYLSSSDSKISYETFKKHILNLAKGKGRISKTKKEYLLEER

DINRFSVQKDFINRNLVDTRYATRGLMNLLRSYFRVNNLDVKVKS

INGGFTSFLRRKWKFKKERNKGYKHHAEDALIIANADFIFKEWKK

LDKAKKVMENQMFEEKQAESMPEIETEQEYKEIFITPHQIKHIKD

FKDYKYSHRVDKKPNRELINDTLYSTRKDDKGNTLIVNNLNGLYD
```

```
KDNDKLKKLINKSPEKLLMYHHDPQTYQKLKLIMEQYGDEKNPLY

KYYEETGNYLTKYSKKDNGPVIKKIKYYGNKLNAHLDITDDYPNS

RNKVVKLSLKPYRFDVYLDNGVYKFVTVKNLDVIKKENYYLVNSK

CYLEAKKLKKISNQAEFIASFYNNDLIKINGELYRVIGVNNDLLN

RIEVNMIDITYREYLENMNDKRPPRIIKTIASKTQSIKKYSTDIL

GNLYEVKSKKHPQIIKKG
```

In some embodiments, wild type Cas9 corresponds to Cas9 from *Streptococcus thermophilus*.

```
Streptococcus thermophilus wild type
CRISPR3 Cas9 (St3Cas9)
                                  (SEQ ID NO: 7)
MTKPYSIGLDIGTNSVGWAVITDNYKVPSKKMKVLGNTSKKYIKKN

LLGVLLFDSGITAEGRRLKRTARRRYTRRRNRILYLQEIFSTEMAT

LDDAFFQRLDDSFLVPDDKRDSKYPIFGNLVEEKVYHDEFPTIYHL

RKYLADSTKKADLRLVYLALAHMIKYRGHFLIEGEFNSKNNDIQKN

FQDFLDTYNAIFESDLSLENSKQLEEIVKDKISKLEKKDRILKLFP

GEKNSGIFSEFLKLIVGNQADFRKCFNLDEKASLHFSKESYDEDLE

TLLGYIGDDYSDVFLKAKKLYDAILLSGFLTVTDNETEAPLSSAMI

KRYNEHKEDLALLKEYIRNISLKTYNEVFKDDTKNGYAGYIDGKTN

QEDFYVYLKNLLAEFEGADYFLEKIDREDFLRKQRTFDNGSIPYQI

HLQEMRAILDKQAKFYPFLAKNKERIEKILTFRIPYYVGPLARGNS

DFAWSIRKRNEKITPWNFEDVIDKESSAEAFINRMTSFDLYLPEEK

VLPKHSLLYETFNVYNELTKVRFIAESMRDYQFLDSKQKKDIVRLY

FKDKRKVTDKDIIEYLHAIYGYDGIELKGIEKQFNSSLSTYHDLLN

IINDKEFLDDSSNEAIIEEIIHTLTIFEDREMIKQRLSKFENIFDK

SVLKKLSRRHYTGWGKLSAKLINGIRDEKSGNTILDYLIDDGISNR

NFMQLIHDDALSFKKKIQKAQIIGDEDKGNIKEVVKSLPGSPAIKK

GILQSIKIVDELVKVMGGRKPESIVVEMARENQYTNQGKSNSQQRL

KRLEKSLKELGSKILKENIPAKLSKIDNNALQNDRLYLYYLQNGKD

MYTGDDLDIDRLSNYDIDHIIPQAFLKDNSIDNKVLVSSASNRGKS

DDFPSLEVVKKRKTFWYQLLKSKLISQRKFDNLTKAERGGLLPEDK

AGFIQRQLVETRQITKHVARLLDEKFNNKKDENNRAVRTVKIITLK

STLVSQFRKDFELYKVREINDFHHAHDAYLNAVIASALLKKYPKLE

PEFVYGDYPKYNSFRERKSATEKVYFYSNIMNIFKKSISLADGRVI

ERPLIEVNEETGESVWNKESDLATVRRVLSYPQVNVVKKVEEQNHG

LDRGKPKGLFNANLSSKPKPNSNENLVGAKEYLDPKKYGGYAGISN

SFAVLVKGTIEKGAKKKITNVLEFQGISILDRINYRKDKLNFLLEK

GYKDIELIIELPKYSLFELSDGSRRMLASILSTNNKRGEIHKGNQI

FLSQKFVKLLYHAKRISNTINENHRKYVENHKKEFEELFYYILEFN

ENYVGAKKNGKLLNSAFQSWQNHSIDELCSSFIGPTGSERKGLFEL

TSRGSAADFEFLGVKIPRYRDYTPSSLLKDATLIHQSVTGLYETRI

DLAKLGEG
```

```
Streptococcus thermophilus CRISPR1 Cas9
wild type (St1Cas9)
                                  (SEQ ID NO: 8)
MSDLVLGLDIGIGSVGVGILNKVTGEIIHKNSRIFPAAQAENNLV

RRTNRQGRRLTRRKKHRRVRLNRLFEESGLITDFTKISINLNPYQ

LRVKGLTDELSNEELFIALKNMVKHRGISYLDDASDDGNSSIGDY

AQIVKENSKQLETKTPGQIQLERYQTYGQLRGDFTVEKDGKKHRL

INVFPTSAYRSEALRILQTQQEFNPQITDEFINRYLEILTGKRKY

YHGPGNEKSRTDYGRYRTSGETLDNIFGILIGKCTFYPDEFRAAK

ASYTAQEFNLLNDLNNLTVPTETKKLSKEQKNQIINYVKNEKAMG

PAKLFKYIAKLLSCDVADIKGYRIDKSGKAEIHTFEAYRKMKTLE

TLDIEQMDRETLDKLAYVLTLNTEREGIQEALEHEFADGSFSQKQ

VDELVQFRKANSSIFGKGWHNFSVKLMMELIPELYETSEEQMTIL

TRLGKQKTTSSSNKTKYIDEKLLTEEIYNPVVAKSVRQAIKIVNA

AIKEYGDFDNIVIEMARETNEDDEKKAIQKIQKANKDEKDAAMLK

AANQYNGKAELPHSVFHGHKQLATKIRLWHQQGERCLYTGKTISI

HDLINNSNQFEVDHILPLSITFDDSLANKVLVYATANQEKGQRTP

YQALDSMDDAWSFRELKAFVRESKTLSNKKKEYLLTEEDISKFDV

RKKFIERNLVDTRYASRVVLNALQEHFRAHKIDTKVSVVRGQFTS

QLRRHWGIEKTRDTYHHHAVDALIIAASSQLNLWKKQKNTLVSYS

EDQLLDIETGELISDDEYKESVFKAPYQHFVDTLKSKEFEDSILF

SYQVDSKFNRKISDATIYATRQAKVGKDKADETYVLGKIKDIYTQ

DGYDAFMKIYKKDKSKFLMYRHDPQTFEKVIEPILENYPNKQINE

KGKEVPCNPFLKYKEEHGYIRKYSKKGNGPEIKSLKYYDSKLGNH

IDITPKDSNNKVVLQSVSPWRADVYFNKTTGKYEILGLKYADLQF

EKGTGTYKISQEKYNDIKKKEGVDSDSEFKFTLYKNDLLLVKDTE

TKEQQLFRFLSRTMPKQKHYVELKPYDKQKFEGGEALIKVLGNVA

NSGQCKKGLGKSNISIYKVRTDVLGNQHIIKNEGDKPKLDF
```

In some embodiments, the Cas9 domain of any of the fusion proteins provided herein is a Cas9 from archaea (e.g. nanoarchaea), which constitute a domain and kingdom of single-celled prokaryotic microbes. In some embodiments, the Cas9 domain is CasX or CasY, which have been described in, for example, Burstein et al., "New CRISPR-Cas systems from uncultivated microbes." *Cell Res.* 2017 Feb. 21. doi: 10.1038/cr.2017.21, which is incorporated herein by reference. Using genome-resolved metagenomics, a number of CRISPR-Cas systems were identified, including the first reported Cas9 in the archaeal domain of life. This divergent Cas9 protein was found in nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napD-NAbp) and are within the scope of this disclosure.

In some embodiments, the Cas9 domain comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring CasX or CasY protein. In some embodiments, the Cas9 domain is a naturally-occurring CasX or CasY protein. In some embodiments, the Cas9 domain comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NOs: 336-337. In some embodiments, the Cas9 domain comprises an amino acid sequence of any one SEQ ID NOs: 336-337. It should be appreciated that CasX and CasY from other bacterial species may also be used in accordance with the present disclosure.

In some embodiments, wild-type Cas9 refers to CasX from *Sulfolobus islandicus* (strain REY15A).

```
                                          (SEQ ID NO: 336)
MEVPLYNIFGDNYIIQVATEAENSTIYNNKVEIDDEELRNVLNLAY

KIAKNNEDAAAERRGKAKKKKGLEGETTTSNIILPLSGNDKNPWTE

TLKCYNFPTTVALSEVFKNFSQVKECEEVSAPSFVKPEFYKFGRSP

GMVERTRRVKLEVEPHYLIMAAAGWVLTRLGKAKVSEGDYVGVNVF

TPTRGILYSLIQNVNGIVPGIKPETAFGLWIARKVVSSVTNPNVSV

VSIYTISDAVGQNPTTINGGFSIDLTKLLEKRDLLSERLEAIARNA

LSISSNMRERYIVLANYIYEYLTGSKRLEDLLYFANRDLIMNLNSD

DGKVRDLKLISAYVNGELIRGEG
```

In some embodiments, wild-type Cas9 refers to CasX from *Sulfolobus islandicus* (strain REY15A).

```
                                          (SEQ ID NO: 337)
MEVPLYNIFGDNYIIQVATEAENSTIYNNKVEIDDEELRNVLNLAY

KIAKNNEDAAAERRGKAKKKKGLEGETTTSNIILPLSGNDKNPWTE

TLKCYNFPTTVALSEVFKNFSQVKECEEVSAPSFVKPEFYEFGRSP

GMVERTRRVKLEVEPHYLIIAAAGWVLTRLGKAKVSEGDYVGVNVF

TPTRGILYSLIQNVNGIVPGIKPETAFGLWIARKVVSSVTNPNVSV

VRIYTISDAVGQNPTTINGGFSIDLTKLLEKRYLLSERLEAIARNA

LSISSNMRERYIVLANYIYEYLTGSKRLEDLLYFANRDLIMNLNSD

DGKVRDLKLISAYVNGELIRGEG
```

In some embodiments, wild-type Cas9 refers to CasY from a Parcubacteria group bacterium.

```
CasY (ncbi.nlm.nih.gov/protein/APG80656.1)
>APG80656.1 CRISPR-associated protein CasY
[uncultured Parcubacteria group bacterium]
                                          (SEQ ID NO: 2469)
MSKRHPRISGVKGYRLHAQRLEYTGKSGAMRTIKYPLYSSPSGGRTV

PREIVSAINDDYVGLYGLSNFDDLYNAEKRNEEKVYSVLDFWYDCVQ

YGAVFSYTAPGLLKNVAEVRGGSYELTKTLKGSHLYDELQIDKVIKF

LNKKEISRANGSLDKLKKDIIDCFKAEYRERHKDQCNKLADDIKNAK

KDAGASLGERQKKLFRDFFGISEQSENDKPSFTNPLNLTCCLLPFDT

VNNNRNRGEVLFNKLKEYAQKLDKNEGSLEMWEYIGIGNSGTAFSNF
```

```
                       -continued
LGEGFLGRLRENKITELKKAMMDITDAWRGQEQEEELEKRLRILAAL

TIKLREPKFDNHWGGYRSDINGKLSSWLQNYINQTVKIKEDLKGHKK

DLKKAKEMINRFGESDTKEEAVVSSLLESIEKIVPDDSADDEKPDIP

AIAIYRRFLSDGRLTLNRFVQREDVQEALIKERLEAEKKKPKKRKK

KSDAEDEKETIDFKELFPHLAKPLKLVPNFYGDSKRELYKKYKNAAI

YTDALWKAVEKIYKSAFSSSLKNSFFDTDFDKDFFIKRLQKIFSVYR

RFNTDKWKPIVKNSFAPYCDIVSLAENEVLYKPKQSRSRKSAAIDKN

RVRLPSTENIAKAGIALARELSVAGFDWKDLLKKEEHEEYIDLIELH

KTALALLLAVTETQLDISALDFVENGTVKDFMKTRDGNLVLEGRFLE

MFSQSIVFSELRGLAGLMSRKEFITRSAIQTMNGKQAELLYIPHEFQ

SAKITTPKEMSRAFLDLAPAEFATSLEPESLSEKSLLKLKQMRYYPH

YFGYELTRTGQGIDGGVAENALRLEKSPVKKREIKCKQYKTLGRGQN

KIVLYVRSSYYQTQFLEWFLHRPKNVQTDVAVSGSFLIDEKKVKTRW

NYDALTVALEPVSGSERVFVSQPFTIFPEKSAELEGQRYLGIDIGEY

GIAYTALEITGDSAKILDQNFISDPQLKTLREEVKGLKLDQRRGTFA

MPSTKIARIRESLVHSLRNRIHHLALKHKAKIVYELEVSRFEEGKQK

IKKVYATLKKADVYSEIDADKNLQTTVWGKLAVASEISASYTSQFCG

ACKKLWRAEMQVDETITTQELIGTVRVIKGGTLIDAIKDFMRPPIFD

ENDTPFPKYRDFCDKHHISKKMRGNSCLFICPFCRANADADIQASQT

IALLRYVKEEKKVEDYFERFRKLKNIKVLGQMKKI
```

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1) or to a Cas9 from any of the organisms listed in Example 1 (SEQ ID NOs: 11-260).

To be used as in the fusion protein of the present disclosure as the guide nucleotide sequence-programmable DNA binding protein domain, a Cas9 protein needs to be nuclease inactive. A nuclease-inactive Cas9 protein may interchangeably be referred to as a "dCas9" protein (for nuclease-"dead" Cas9). Methods for generating a Cas9 protein (or a fragment thereof) having an inactive DNA cleavage domain are known (See, e.g., Jinek et al., *Science*. 337:816-821(2012); Qi et al., (2013) *Cell*. 28; 152(5):1173-83, each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821(2012); Qi et al., *Cell*. 28; 152(5): 1173-83 (2013)).

dCas9 (D10A and H840A)

(SEQ ID NO: 2)

MDKK<u>YSIGLAIGTNSVGWAVITDEYKVPSKKFKVLGNTDRHSIKKNLIGALLFDSGET</u>AEATRLKRTAR

RRYTRRKNRICYLQEIFSNEMAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLLKALVRQQLPEK

YKEIFFDQSKNGYAGYIDGGASQEEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGA

SAQSFIERMTNFDKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILDFLKSDGFANRN

FMQLIHDDSLTFKEDIQKAQVSGQG<u><u>DSLHEHIANLAGSPAIKKGILQTVKVVDELVKVMGRHKPENIVI</u></u>

<u><u>EMAR</u></u>ENQTTQKGQKNSRERMKRIEEGIKELGSQILKEHPVENTQLQNEKLYLYYLQNGRDMYVDQEL

DINRLSDYDVDAIVPQSFLKDDSIDNKVLTRSDKNRGKSDNVPSEEVVKKMKNYWRQLLNAKLITQRK

FDNLTKAERG<u>GLSELDKAGFIKRQLVETRQITKHVAQILDSRMNTKYDENDKLIREVKVITLKSKLVSD</u>

<u>FRKDFQFYKVREINNYHHAHDAYLNAVVGTALIKKYPKLESEFVYGDYKVYDVRKMIAKSEQEIGKA</u>

<u>T</u>AKYFFYSNIMNFFKTEITLANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEKGKSKKLKSVKELLGITIME

RSSFEKNPIDFLEAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKHRDKPIREQAENI

IHLFTLTNLGAPAAFKYFDTTIDRKRYTSTKEVLDATLIHQSITGLYETRIDLSQLGGD
(single underline: HNH domain; double underline: RuvC domain)

The dCas9 of the present disclosure encompasses completely inactive Cas9 or partially inactive Cas9. For example, the dCas9 may have one of the two nuclease domain inactivated, while the other nuclease domain remains active. Such a partially active Cas9 may also be referred to as a Cas9 nickase, due to its ability to cleave one strand of the targeted DNA sequence. The Cas9 nickase suitable for use in accordance with the present disclosure has an active HNH domain and an inactive RuvC domain and is able to cleave only the strand of the target DNA that is bound by the sgRNA (which is the opposite strand of the strand that is being edited via cytidine deamination). The Cas9 nickase of the present disclosure may comprise mutations that inactivate the RuvC domain, e.g., a D10A mutation. It is to be understood that any mutation that inactivates the RuvC domain may be included in a Cas9 nickase, e.g., insertion, deletion, or single or multiple amino acid substitution in the RuvC domain. In a Cas9 nickase useful in the present disclosure, while the RuvC domain is inactivated, the HNH domain remains activate. Thus, while the Cas9 nickase may comprise mutations other than those that inactivate the RuvC domain (e.g., D10A), those mutations do not affect the activity of the HNH domain. In a non-limiting Cas9 nickase example, the histidine at position 840 remains unchanged. The sequence of an exemplary Cas9 nickase suitable for the present disclosure is provided below.

*S. pyogenes* Cas9 Nickase (D10A)

(SEQ ID NO: 3)

MDKK<u>YSIGLAIGTNSVGWAVITDEYKVPSKKFKVLGNTDRHSIKKNLIGALLFDSGET</u>AEATRLKRTAR

RRYTRRKNRICYLQEIFSNEMAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLLKALVRQQLPEKY

KEIFFDQSKNGYAGYIDGGASQEEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGA

SAQSFIERMTNFDKNLPNEKVLPKHSLLYEYFTVYNELTKVKYVTEGMRKPAFLSGEQKKAIVDLLFKT

NRKVTVKQLKEDYFKKIECFDSVEISGVEDRFNASLGTYHDLLKIIKDKDFLDNEENEDILEDIVLTLT

```
LFEDREMIEERLKTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEKGKSKKLKSVKELLGITIM

ERSSFEKNPIDFLEAKGYKEVKKDLIIKLPKYSLFELENGRKRMLASAGELQKGNELALPSKYVNFLY

LASHYEKLKGSPEDNEQKQLFVEQHKHYLDEIIEQISEFSKRVILADANLDKVLSAYNKHRDKPIREQ

AENIIHLFTLTNLGAPAAFKYFDTTIDRKRYTSTKEVLDATLIHQSITGLYETRIDLSQLGGD (single underline: HNH domain; double underline: RuvC domain)
S. aureus Cas9 Nickase (D10A)
                                                          (SEQ ID NO: 4)
MKRNYILGLAIGITSVGYGIIDYETRDVIDAGVRLFKEANVENNEGRRSKRGARRLKRRRRHRIQRVKK

LLFDYNLLTDHSELSGINPYEARVKGLSQKLSEEEFSAALLHLAKRRGVHNVNEVEEDTGNELSTKEQI

SRNSKALEEKYVAELQLERLKKDGEVRGSINRFKTSDYVKEAKQLLKVQKAYHQLDQSFIDTYIDLLE

TRRTYYEGPGEGSPFGWKDIKEWYEMLMGHCTYFPEELRSVKYAYNADLYNALNDLNNLVITRDENEKL

EYYEKFQIIENVFKQKKKPTLKQIAKEILVNEEDIKGYRVTSTGKPEFTNLKVYHDIKDITARKEIIEN

AELLDQIAKILTIYQSSEDIQEELTNLNSELTQLEIEQISNLKGYTGTHNLSLKAINLILDELWHTNDNQ

IAIFNRLKLVPKKVDLSQQKEIPTTLVDDFILSPVVKRSFIQSIKVINAIIKKYGLPNDIIIELAREKNS

KDAQKMINEMQKRNRQTNERIEEIIRTTGKENAKYLIEKIKLHDMQEGKCLYSLEAIPLEDLLNNPFNYL

VDHIIPRSVSFDNSFNNKVLVKQEENSKKGNRTPFQYLSSSDSKISYETFKKHILNLAKGKGRISKTKKE

YLLEERDINRFSVQKDFINRNLVDTRYATRGLMNLLRSYFRVNNLDVKVKSINGGFTSFLRRKWKFKKER

NKGYKHHAEDALIIANADFIFKEWKKLDKAKKVMENQMFEEKQAESMPEIETEQEYKEIFITPHQIKHI

KDFKDYKYSHRVDKKPNRELINDTLYSTRKDDKGNTLIVNNLNGLYDKDNDKLKKLINKSPEKLLMYHH

DPQTYQKLKLIMEQYGDEKNPLYKYYEETGNYLTKYSKKDNGPVIKKIKYYGNKLNAHLDITDDYPNSR

NKVVKLSLKPYRFDVYLDNGVYKFVTVKNLDVIKKENYYLVNSKCYLEAKKLKKISNQAEFIASFYNND

LIKINGELYRVIGVNNDLLNRIEVNMIDITYREYLENMNDKRPPRIIKTIASKTQSIKKYSTDILGNLY

EVKSKKHPQIIKKG
```

It is appreciated that when the term "dCas9" or "nuclease-inactive Cas9" is used herein, it refers to Cas9 variants that are inactive in both HNH and RuvC domains as well as Cas9 nickases. For example, the dCas9 may include the amino acid sequence set forth in SEQ ID NO: 2 or SEQ ID NO: 3. In some embodiments, the dCas9 may comprise other mutations that inactivate RuvC or HNH domain. Additional suitable mutations that inactivate Cas9 will be apparent to those of skill in the art based on this disclosure and knowledge in the field, and are within the scope of this disclosure. Such additional exemplary suitable nuclease-inactive Cas9 domains include, but are not limited to, D839A and/or N863A (See, e.g., Prashant et al., *Nature Biotechnology*. 2013; 31(9): 833-838, which are incorporated herein by reference), or K603R (See, e.g., Chavez et al., *Nature Methods* 12, 326-328, 2015, which is incorporated herein by reference). The term Cas9, dCas9, or Cas9 variant also encompasses Cas9, dCas9, or Cas9 variants from any organism. Also appreciated is that dCas9, Cas9 nickase, or other appropriate Cas9 variants from any organisms may be used in accordance with the present disclosure.

A "deaminase" refers to an enzyme that catalyzes the removal of an amine group from a molecule, or deamination, for example through hydrolysis. In some embodiments, the deaminase is a cytidine deaminase, catalyzing the deamination of cytidine (C) to uridine (U), deoxycytidine (dC) to deoxyuridine (dU), or 5-methyl-cytidine to thymidine (T, 5-methyl-U), respectively. Subsequent DNA repair mechanisms ensure that a dU is replaced by T, as described in Komor et al (*Nature*, Programmable editing of a target base in genomic DNA without double-stranded DNA cleavage, 533, 420-424 (2016), which is incorporated herein by reference). In some embodiments, the deaminase is a cytosine deaminase, catalyzing and promoting the conversion of cytosine to uracil (e.g., in RNA) or thymine (e.g., in DNA). In some embodiments, the deaminase is a naturally-occurring deaminase from an organism, such as a human, chimpanzee, gorilla, monkey, cow, dog, rat, or mouse. In some embodiments, the deaminase is a variant of a naturally-occurring deaminase from an organism, and the variants do not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase from an organism.

A "cytosine deaminase" refers to an enzyme that catalyzes the chemical reaction "cytosine+$H_2O$→uracil→$NH_3$" or "5-methyl-cytosine+$H_2O$→thymine+$NH_3$." As it may be apparent from the reaction formula, such chemical reactions result in a C to U/T nucleobase change. In the context of a gene, such nucleotide change, or mutation, may in turn lead to an amino acid change in the protein, which may affect the protein's function, e.g., loss-of-function or gain-of-function. Subsequent DNA repair mechanisms ensure that uracil bases in DNA are replaced by T, as described in Komor et al (*Nature*, Programmable editing of a target base in genomic DNA without double-stranded DNA cleavage, 533, 420-424 (2016), which is incorporated herein by reference).

One exemplary suitable class of cytosine deaminases is the apolipoprotein B mRNA-editing complex (APOBEC) family of cytosine deaminases encompassing eleven proteins that serve to initiate mutagenesis in a controlled and beneficial manner. The apolipoprotein B editing complex 3 (APOBEC3) enzyme provides protection to human cells against a certain HIV-1 strain via the deamination of cytosines in reverse-transcribed viral ssDNA. These cytosine deaminases all require a $Zn^{2+}$-coordinating motif (His-X-Glu-$X_{23-26}$-Pro-Cys-$X_{2-4}$-Cys; SEQ ID NO: 1996) and bound water molecule for catalytic activity. The glutamic acid residue acts to activate the water molecule to a zinc hydroxide for nucleophilic attack in the deamination reaction. Each family member preferentially deaminates at its own particular "hotspot," for example, WRC (W is A or T, R is A or G) for hAID, or TTC for hAPOBEC3F. A recent crystal structure of the catalytic domain of APOBEC3G revealed a secondary structure comprising a five-stranded j-sheet core flanked by six α-helices, which is believed to be conserved across the entire family. The active center loops have been shown to be responsible for both ssDNA binding and in determining "hotspot" identity. Overexpression of these enzymes has been linked to genomic instability and cancer, thus highlighting the importance of sequence-specific targeting. Another suitable cytosine deaminase is the activation-induced cytidine deaminase (AID), which is responsible for the maturation of antibodies by converting cytosines in ssDNA to uracils in a transcription-dependent, strand-biased fashion.

The term "base editors" or "nucleobase editors," as used herein, broadly refer to any of the fusion proteins described herein. In some embodiments, the nucleobase editors are capable of precisely deaminating a target base to convert it to a different base, e.g., the base editor may target C bases in a nucleic acid sequence and convert the C to T base. For example, in some embodiments, the base editor may be a cytosine deaminase-dCas9 fusion protein. In some embodiments, the base editor may be a cytosine deaminase-Cas9 nickase fusion protein. In some embodiments, the base editor may be a deaminase-dCas9-UGI fusion protein. In some embodiments, the base editor may be an UGI-deaminase-dCas9 fusion protein. In some embodiments, the base editor may be an UGI-deaminase-Cas9 nickase fusion protein. In some embodiments, the base editor may be an APOBEC1-dCas9-UGI fusion protein. In some embodiments, the base editor may be an APOBEC1-Cas9 nickase-UGI fusion protein. In some embodiments, the base editor may be an APOBEC1-dCpf1-UGI fusion protein. In some embodiments, the base editor may be an APOBEC1-dNgAgo-UGI fusion protein. In some embodiments, the base editor may comprise a second UGI domain. Non-limiting exemplary sequences of the nucleobase editors useful in the present disclosure are provided in Example 1, SEQ ID NOs: 293-302 and 2495. Such nucleobase editors and methods of using them for genome editing have been described in the art, e.g., in U.S. Pat. No. 9,068,179, US Patent Application Publications US 2015/0166980, US 2015/0166981, US 2015/0166982, US20150166984, and US20150165054, and US Provisional Applications, U.S. Ser. No. 62/245,828, filed Oct. 23, 2015; 62/279,346, filed Jan. 15, 2016; 62/311,763, filed Mar. 22, 2016; 62/322,178, filed Apr. 13, 2016, 62/357, 352, filed Jun. 30, 2016, U.S. Pat. No. 62,370,700, filed Aug. 3, 2016; 62/398,490, filed Sep. 22, 2016; 62/408,686, filed Oct. 14, 2016; PCT Application PCT/US2016/058344, filed Oct. 22, 2016; U.S. patent application Ser. No. 15/311,852, filed Oct. 22, 2016; Komor et al. (2017) Improved Base Excision Repair Inhibition and Baeriophage Mu Gam Protein Yields C:G-to-T:A base editors with higher efficiency and product purity. *Sci Adv,* 3: eaao4774; and in Komor et al., *Nature*, Programmable editing of a target base in genomic DNA without double-stranded DNA cleavage, 533, 420-424 (2016), the entire contents of each of which is incorporated herein by reference.

The term "target site" or "target sequence" refers to a sequence within a nucleic acid molecule (e.g., a DNA molecule) that is deaminated by the fusion protein provided herein. In some embodiments, the target sequence is a polynucleotide (e.g., a DNA), wherein the polynucleotide comprises a coding strand and a complementary strand. The meaning of a "coding strand" and "complementary strand," as used herein, is the same as the common meaning of the terms in the art. In some embodiments, the target sequence is a sequence in the genome of a mammal. In some embodiments, the target sequence is a sequence in the genome of a human. In some embodiments, the target sequence is a sequence in the genome of a non-human animal The term "target codon" refers to the amino acid codon that is edited by the base editor and converted to a different codon via deamination. The term "target base" refers to the nucleotide base that is edited by the base editor and converted to a different base via deamination. In some embodiments, the target codon in the coding strand is edited (e.g., deaminated). In some embodiments, the target codon in the complimentary strand is edited (e.g., deaminated).

The term "linker," as used herein, refers to a chemical group or a molecule linking two molecules or moieties, e.g., two domains of a fusion protein, such as, for example, a nuclease-inactive Cas9 domain and a nucleic acid editing domain (e.g., a deaminase domain). Typically, the linker is positioned between, or flanked by, two groups, molecules, domains, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer (e.g. a non-natural polymer, non-peptidic polymer), or chemical moiety. In some embodiments, the linker is 2-100 amino acids in length, for example, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* (4$^{th}$ ed., Cold Spring Harbor Laboratory Press, Cold Spring Harbor, N.Y. (2012)).

The terms "nucleic acid," and "polynucleotide," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* (4$^{th}$ ed., Cold Spring Harbor Laboratory Press, Cold Spring Harbor, N.Y. (2012)), which are incorporated herein by reference.

The term "subject," as used herein, refers to an individual organism, for example, an individual mammal. A "subject in need thereof", refers to an individual who has a disease, a symptom of the disease, or a predisposition toward the disease, with the purpose to cure, heal, alleviate, relieve, alter, remedy, ameliorate, improve, or affect the disease, the symptom of the disease, or the predisposition toward the disease. In some embodiments, the subject is a mammal. In some embodiments, the subject is a non-human primate. In some embodiments, the subject is human. In some embodiments, the mammal is a rodent. In some embodiments, the rodent is a mouse. In some embodiments, the rodent is a rat. In some embodiments, the mammal is a companion animal. A "companion animal" refers to pets and other domestic animals. Non-limiting examples of companion animals include dogs and cats; livestock such as horses, cattle, pigs, sheep, goats, and chickens; and other animals such as mice, rats, guinea pigs, and hamsters.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence. The fusion proteins (e.g., base editors) useful in the present disclosure are made recombinantly. Recombinant technology is familiar to those skilled in the art.

An "intron" refers to any nucleotide sequence within a gene that is removed by RNA splicing during maturation of the final RNA product. The term intron refers to both the DNA sequence within a gene and the corresponding sequence in RNA transcripts. Sequences that are joined together in the final mature RNA after RNA splicing are exons. Introns are found in the genes of most organisms and many viruses, and can be located in a wide range of genes, including those that generate proteins, ribosomal RNA (rRNA), and transfer RNA (tRNA). When proteins are generated from intron-containing genes, RNA splicing takes place as part of the RNA processing pathway that follows transcription and precedes translation.

An "exon" refers to any part of a gene that will become a part of the final mature RNA produced by that gene after introns have been removed by RNA splicing. The term exon refers to both the DNA sequence within a gene and to the corresponding sequence in RNA transcripts. In RNA splicing, introns are removed and exons are covalently joined to one another as part of generating the mature messenger RNA.

"Splicing" refers to the processing of a newly synthesized messenger RNA transcript (also referred to as a primary mRNA transcript). After splicing, introns are removed and exons are joined together (ligated) for form mature mRNA molecule containing a complete open reading frame that is decoded and translated into a protein. For nuclear-encoded genes, splicing takes place within the nucleus either co-transcriptionally or immediately after transcription. The molecular mechanism of RNA splicing has been extensively described, e.g., in Pagani et al., Nature Reviews Genetics 5, 389-396, 2004; Clancy et al., Nature Education 1 (1): 31, 2011; Cheng et al., Molecular Genetics and Genomics 286 (5-6): 395-410, 2014; Taggart et al., Nature Structural & Molecular Biology 19 (7): 719-2, 2012, the contents of each of which are incorporated herein by reference. One skilled in the art is familiar with the mechanism of RNA splicing.

"Alternative splicing" refers to a regulated process during gene expression that results in a single gene coding for multiple proteins. In this process, particular exons of a gene may be included within or excluded from the final, processed messenger RNA (mRNA) produced from that gene. Consequently, the proteins translated from alternatively spliced mRNAs will contain differences in their amino acid sequence and, often, in their biological functions. Notably, alternative splicing allows the human genome to direct the synthesis of many more proteins than would be expected from its 20,000 protein-coding genes. Alternative splicing is sometimes also termed differential splicing. Alternative splicing occurs as a normal phenomenon in eukaryotes, where it greatly increases the biodiversity of proteins that can be encoded by the genome; in humans, ~95% of multi-exonic genes are alternatively spliced. There are numerous modes of alternative splicing observed, of which the most common is exon skipping. In this mode, a particular exon may be included in mRNAs under some conditions or in particular tissues, and omitted from the mRNA in others. Abnormal variations in splicing are also implicated in disease; a large proportion of human genetic disorders result from splicing variants. Abnormal splicing variants are also thought to contribute to the development of cancer, and splicing factor genes are frequently mutated in different types of cancer. The regulation of alternative splicing is also described in the art, e.g., in Douglas et al., Annual Review of Biochemistry 72 (1): 291-336, 2003; Pan et al., Nature Genetics 40 (12): 1413-1415, 2008; Martin et al., Nature Reviews 6 (5): 386-398, 2005; Skotheim et al., The international journal of biochemistry & cell biology 39 (7-8): 1432-49, 2007, each of which is incorporated herein by reference.

A "coding frame" or "open reading frame" refers to a stretch of codons that encodes a polypeptide. Since DNA is interpreted in groups of three nucleotides (codons), a DNA strand has three distinct reading frames. The double helix of a DNA molecule has two anti-parallel strands so, with the two strands having three reading frames each, there are six possible frame translations. A functional protein may be produced when translation proceeds in the correct coding frame. An insertion or a deletion of one or two bases in the open reading frame causes a shift in the coding frame that is also referred to as a "frameshift mutation." A frameshift mutation typical results in premature translation termination and/or truncated or non-functional protein.

A "neurotropic virus" is a virus that is capable of accessing or entering the nervous system and neurovirulent if it is capable of causing disease within the nervous system (e.g., CNS or PNS). Important neuroinvasive viruses include poliovirus, which is highly neurovirulent but weakly neuroinvasive, and rabies virus, which is highly neurovirulent but requires tissue trauma (often resulting from an animal bite) to become neuroinvasive. Neurotropic viral delivery vectors may be derived from neurotropic virus to facilitate the delivery of agents (e.g., therapeutic agents for neurological diseases) to neurons. Non-limiting, exemplary neurotropic viruses that may be used to develop neurotropic viral delivery vectors include: Japanese encephalitis virus, Venezuelan equine encephalitis virus, California encephalitis viruses; polio virus, coxsackie virus, echo virus, mumps virus, measles virus, influenza virus, rabies virus, herpes simplex virus, varicella-zoster virus, Epstein-Barr virus, cytomegalo virus, and HHV-6 virus. Methods of using neurotropic viral delivery vectors to delivery therapeutic agents to neurons have been described in the art, e.g., in Lim et al., Pharmacol Res. 2010 January; 61(1): 14-26; Berges et al., Molecular Therapy, Volume 15, Issue 1, January 2007, Pages 20-29; and Beverly et al., Nature Reviews Neuroscience 4, 353-364, 2003, each of which in incorporated herein by reference.

Other viruses that are known to be suitable for gene transfer may also be used to deliver agents to neurons, e.g., adeno-associated virus (AAV), lentivirus, and retrovirus. An AAV-based neurotropic viral delivery system has recently been described in Deverman et al., Nature Biotechnology 34, 204-209 (2016), incorporated herein by reference. Delivery of a split Cas9 using AAV has also been described, e.g., in Truong et al., Nucl. Acids Res. 43, 6450 (2016), and U.S. Provisional Application 62/408,575, filed Oct. 14, 2016, each of which is incorporated herein by reference.

These and other exemplary substituents are described in more detail in the Detailed Description, Examples, and Claims. The invention is not intended to be limited in any manner by the above exemplary listing of substituents.

DETAILED DESCRIPTION OF CERTAIN EMBODIMENTS

A normal physiological outcome of trauma, inflammation, and/or nerve injury is the induction of gene expression changes in neighboring nociceptive neurons during the period required for healing. Such changes in gene expression, for example, may facilitate the firing of action potentials by neurons at a lower activation threshold and in turn underlie the sensations of pain (e.g., hyperalgesia (increased pain sensitivity) and allodynia (pain following a normally innocuous stimulus)). Chronic pain develops when the enhanced sensitization of sensory neurons becomes irreversibly established and becomes a persistent maladaptive condition. The functional specialization of sensory neurons is driven by the expression of dedicated ion channel genes (e.g., the ion channel genes listed in Table 12) that fine-tune the membrane polarization to trigger and propagate action potentials in response to stimuli. Accordingly, the etiology of chronic pain can be attributed to, at least in part, the dysregulated expression of one or more genes in one or more neurons.

Figure 1B:
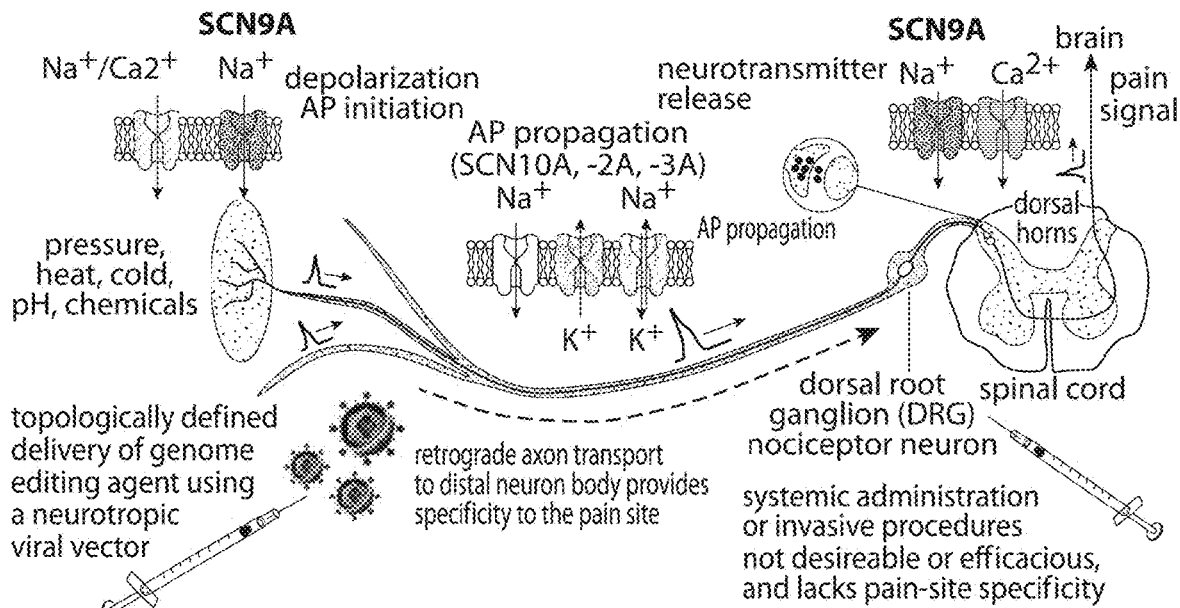
Figure 1C:
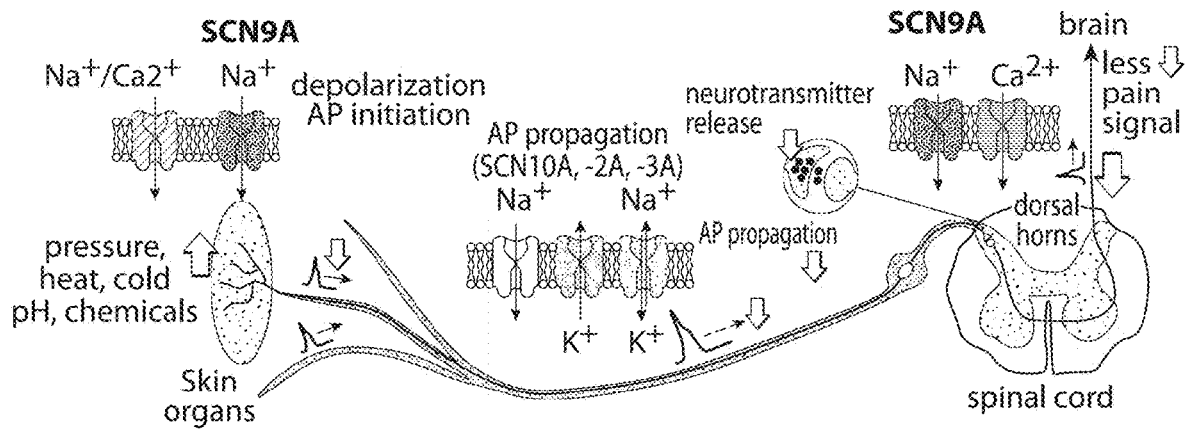

In general, the types of chronic pain that occur in most parts of the body and the extremities involve afferent neurons of the dorsal root ganglia (DRG), which reside in clusters of nerve cells near the spinal cord and have long axons extending towards, for example, the skin, muscles, and organs (FIG. 1). The mechanism of enhanced excitability involves voltage-gated ion channels and background/leak channels that set the resting membrane potential and firing threshold of DRG neurons. Under normal conditions, chemical, mechanical, or thermal stimuli are required to activate receptors and ion channels in peripheral nerve endings to initiate action potentials that propagate along the axons of DRG neurons. In some instances, the dendritic termini of the DRG neurons liberate glutamate and substance-P at synapses in the spinal cord dorsal horn, activating second-order neurons that communicate pain signals to the brain.

Human DRG neurons constitutively express specific and specialized ion channels that have been implicated in afferent pain signaling, which may be targeted for modulation of chronic pain conditions. Three sodium channels (NaV1.7, NaV1.8, and NaV1.9) are constitutively expressed in DRG neurons, and a fourth gene (NaV1.3) displays elevated expression after nerve injury (Table 12). In some embodiments, targeting the ion channels using the strategies described herein leads to gene ablation, loss-of-function, destabilization of the transcript and/or protein folding of the targeted ion channels, which in turn leads to reduced pain transmission. In some embodiments, the normal function of the DRG neurons in triggering action potentials and reaching a normal membrane depolarization threshold is not comprised post editing.

Thus, in some embodiments, a polynucleotide encoding any one of NaV1.7, NaV1.8, NaV1.9, NaV1.3, CaV3.2, HCN1, HCN2, or Ano1 ion-channels is targeted by a genome editing agent (e.g., a nucleobase editor, nuclease). In some embodiments, a polynucleotide (e.g., DNA) encoding NaV1.7 ion channel is targeted.

In a human genome, the NaV1.7 ion channel is encoded by the SCN9A gene. Thus, in some embodiments, the nucleobase editor targets the SCN9A gene in a genome, e.g., a human genome. Disruption of SCN9A is only desirable at a localized level, because nociception is essentially a protective mechanism from overextension and deformation of our joints and muscles, and it is also necessary for our sense of smell. Humans presenting homozygous SCN9A loss-of-function mutations may suffer from congenital insensitivity to pain (CIP). Conversely, gain-of-function mutations in the sodium channels NaV1.7 (SCN9A) or NaV1.8 (SCN10A) cause congenital pain syndromes, such as primary erythermalgia. In some embodiments, the SCN9A gene is involved in itching.

Various genome-editing agents useful in the present disclosure may be deployed to the DRG neurons (e.g., dysregulated DRG neurons to modify the genes responsible for propagation of pain signals in DRG neurons. The strategies for pain (e.g., chronic pain) suppression described herein are superior to traditional methods of pain management due to their high specificity, efficacy, and safety profile. In some embodiments, one or more design elements may be utilized in the strategies described herein that achieves precise and selective targeting of pain-causative neurons. Such design elements include, for example: 1) localized delivery of a non-replicative viral vector that requires synaptic terminals, sparing the bulk of somatic tissues near the pain site, 2) neuron-specific promoters that drive expression of the genome editing construct; and/or 3) guide-RNA programmed targeting of non-essential ion channel genes exclusively expressed by DRG neurons to spare other types of neurons (efferent neurons, interneurons, etc.).

Some aspects of the present disclosure relate to editing a polynucleotide encoding an ion channel in a DRG neuron, the method comprising contacting the ion channel-encoding polynucleotide with a nucleobase editor described herein and a guide nucleotide sequence targeting the nucleobase editor to a target site in the ion channel-encoding polynucleotide. The nucleobase editors described herein target C bases. Contacting the nucleobase editor with a target C base (e.g., a target C base in a ion channel-encoding polynucleotide) results in a cytosine (C) to thymine (T) change in the ion channel-encoding polynucleotide. Such C to T base change ultimately leads to a C:G to T:A base pair change.

Strategies for Targeting Ion Channels in DRG Neurons

The targeted editing of polynucleotides encoding ion channels in neurons (e.g., DRG neurons) may be achieved, in some embodiments, using nucleobase editors as described in, e.g., U.S. Pat. No. 9,068,179, issued Jun. 30, 2015, US Patent Application Publications US 2015/0166980, US 2015/0166981, US 2015/0166982, US 2015/0166984, and US 2015/0165054, and US Provisional Applications, U.S. Ser. No. 62/245,828, filed Oct. 23, 2015; 62/279,346, filed Jan. 15, 2016; 62/311,763, filed Mar. 22, 2016; 62/322,178, filed Apr. 13, 2016, 62/357,352, filed Jun. 30, 2016, U.S. Pat. No. 62/370,700, filed Aug. 3, 2016; 62/398,490, filed Sep. 22, 2016; and 62/408,686, filed Oct. 14, 2016; PCT Application PCT/US2016/058344, filed Oct. 22, 2016; US patent application U.S. Ser. No. 15/311,852, filed Oct. 22, 2016; and in Komor et al., Nature, Programmable editing of a target base in genomic DNA without double-stranded DNA cleavage, 533, 420-424 (2016), the entire contents of each of which are incorporated herein by reference.

The nucleobase editors can precisely edit a target base in an ion channel-encoding polynucleotide without introducing a DNA double stand break, thus reducing genome instability and preventing possible oncogenic modifications that may be caused by other genome editing methods. The nucleobase editors described herein may be programmed to target and modify a single base. In some embodiments, the target base is a cytosine (C) base and may be converted to a thymine (T) base via deamination by the nucleobase editor.

In some embodiments, the ion channel-encoding polynucleotide is a DNA molecule comprising a coding strand and a complementary strand, e.g., a gene locus for the ion channel in a genome. The target base may be on either the coding-strand or the complementary strand of an ion channel-encoding polynucleotide. In some embodiments, the ion channel-encoding polynucleotide includes coding regions (e.g., exons) and non-coding regions (e.g., introns or splicing sites). In some embodiments, the target base (e.g., a C base) is located in the coding region (e.g., an exon) of the ion channel-encoding polynucleotide (e.g., the ion channel gene locus). In some embodiments, the conversion of a base in the coding region results in an amino acid change in the ion channel protein sequence, i.e., a mutation. In some embodiments, editing the ion channel-encoding polynucleotide results in a loss-of-function mutant (e.g., for SCN9A). In some embodiments, editing the ion channel-encoding polynucleotide results in a gain-of-function mutant (e.g., for SCN11A).

In some embodiments, the target base is located in a non-coding region of the ion channel-encoding polynucleotide, e.g., in an intron or a splicing site. In some embodiments, a target base is located in a splicing site and the editing of such target base causes alternative splicing of the ion channel mRNA. In some embodiments, the alternative splicing leads to loss-of-function ion-channel mutants. In some embodiments, the alternative splicing leads to the introduction of a premature stop codon in an ion channel mRNA, resulting in truncated and/or unstable ion channel proteins. In some embodiments, ion channel mutants that are defective in folding are produced.

In some embodiments, the activity of a loss-of-function ion channel variant may be reduced by at least 20%, at least 30%, at least 40%, at least 50%, at least 60%, at least 70%, at least 80%, at least 90%, at least 99%, or more. In some embodiments, the loss-of-function ion channel variant has no more than 50%, no more than 40%, no more than 30%, no more than 20%, no more than 10%, no more than 5%, no more than 1%, or less activity compared to a wild type ion channel protein.

In some embodiments, the activity of a gain-of-function ion channel variant may be elevated by at least 20%, at least 30%, at least 40%, at least 50%, at least 60%, at least 70%, at least 80%, at least 90%, at least 99%, or more. In some embodiments, the loss-of-function ion channel variant has no more than 50%, no more than 40%, no more than 30%, no more than 20%, no more than 10%, no more than 5%, no more than 1%, or less activity compared to a wild type ion channel protein.

To edit the ion channel-encoding polynucleotide gene, the ion channel-encoding nucleotide may contacted with a genome-editing agent (e.g., a programmable nuclease or a nucleobase editor), wherein the genome-editing agent binds to its target sequence and edits the target site. For example, the genome-editing agent (e.g., a nucleobase editor) may be expressed in a cell where editing is desired (e.g., a DRG neuron), to thereby allow contacting of the ion channel gene with the agent. In some embodiments, the binding of the genome editing agent (e.g., a nucleobase editor) to its target sequence in the ion channel-encoding polynucleotide is mediated by a guide nucleotide sequence, e.g., a guide RNA (gRNA). The guide nucleotide sequence is designed to be complementary to one of the strands of the target sequence in the ion channel-encoding polynucleotide. The guide nucleotide sequence may be engineered to guide the nucleobase editor to any target base (e.g., target bases listed in Table 2) in an ion channel gene (e.g., SCN9A), provided that a PAM is located 3' of the target base. In some embodiments, the guide nucleotide sequence is co-expressed with the programmable nuclease or nucleobase editor in a cell where editing is desired (e.g., a DRG neuron). In some embodiments, a programmable nuclease or a nucleobase editor in complex with a gRNA is delivered to a cell where editing is desired (e.g., a DRG neuron). Strategies of editing the ion channel genes using nucleobase editors are provided.

Codon Change

Using the nucleobase editors, an amino acid codon may be converted to a different codon via deamination of a target base within the codon. For example, in some embodiments, a cytosine (C) base is converted to a thymine (T) base via deamination by a nucleobase editor comprising a cytosine deaminase domain (e.g., APOBEC1 or AID). It is worth noting that during a C to T change via deamination (e.g., by a cytosine deaminase such as APOBEC1 or AID), the cytosine is first converted to a uridine (U), leading to a G:U mismatch. The G:U mismatch is then converted by DNA repair machinery and replication pathways to T:A pair, thus introducing the thymine at the position of the original cytosine. In some embodiments, conversion of a base in an amino acid codon may lead to a change of the amino acid the codon encodes. Cytosine deaminases are capable of converting a cytosine (C) base to a thymine (T) base via deamination. Thus, it is envisioned that, for amino acid codons containing a C base, the C base may be directly converted to T. For example, codon (CTC) for leucine may be changed to a TTC (phenylalanine) codon via the deamination of the first C on the coding strand. For amino acid codons that contain a guanine (G) base, a C base is present on the complementary strand; and the G base may be converted to an adenosine (A) via the deamination of the C on the complementary strand. For example, an ATG (Met/M) codon may be converted to a ATA (Ile/I) codon via the deamination of the third C on the complementary strand. In some embodiments, two C to T changes are required to convert a codon to a different codon. Non-limiting examples of possible mutations that may be made (e.g., in the ion channel-encoding polynucleotide) by the nucleobase editors of the present disclosure are summarized in Table 1.

TABLE 1

Exemplary Codon Changes via Base Editing

| Target codon | Base-editing reaction (s) | Edited codon |
| --- | --- | --- |
| CTT (Leu/L) | 1st base C to T on coding strand | TTT (Phe/F) |
| CTC (Leu/L) | 1st base C to T on coding strand | TTC (Phe/F) |
| ATG (Met/M) | 3rd base C to T on complementary strand | ATA (Ile/I) |
| GTT (Val/V) | 1st base C to T on complementary stand | ATT (Ile/I) |
| GTA (Val/V) | 1st base C to T on complementary strand | ATA (Ile/I) |
| GTC (Val/V) | 1st base C to T on complementary strand | ATC (Ile/I) |
| GTG (Val/V) | 1st base C to T on complementary strand | ATG (Met/M) |
| TCT (Ser/S) | 2nd base C to T on coding strand | TTT (Phe/F) |
| TCC (Ser/S) | 2nd base C to T on coding strand | TTC (Phe/F) |
| TCA (Ser/S) | 2nd base C to T on coding strand | TTA (Leu/L) |
| TCG (Ser/S) | 2nd base C to T on coding strand | TTG (Leu/L) |
| AGT (Ser/S) | 2nd base C to T on complementary strand | AAT (Asp/N) |
| AGC (Ser/S) | 2nd base C to T on complementary strand | AAC (Aps/N) |

TABLE 1-continued

Exemplary Codon Changes via Base Editing

| Target codon | Base-editing reaction(s) | Edited codon |
|---|---|---|
| CCT (Pro/P) | 1st base C to T on coding strand | TCT (Ser/S) |
| CCC (Pro/P) | 1st base C to T on coding strand | TCC (Ser/S) |
| CCA (Pro/P) | 1st base C to T on coding strand | TCA (Ser/S) |
| CCG (Pro/P) | 1st base C to T on coding strand | TCG (Ser/S) |
| CCT (Pro/P) | 2nd base C to T on coding strand | CTT (Leu/L) |
| CCC (Pro/P) | 2nd base C to T on coding strand | CTC (Leu/L) |
| CCA (Pro/P) | 2nd base C to T on coding strand | CTA (Leu/L) |
| CCG (Pro/P) | 2nd base C to T on coding strand | CTG (Leu/L) |
| ACT (Thr/T) | 2nd base C to T on coding strand | ATT (Leu/L) |
| ACC (Thr/T) | 2nd base C to T on coding strand | ATC (Leu/L) |
| ACA (Thr/T) | 2nd base C to T on coding strand | ATA (Leu/L) |
| ACG (Thr/T) | 2nd base C to T on coding strand | ATG (Met/M) |
| GCT (Ala/A) | 2nd base C to T on coding strand | GTT (Val/V) |
| GCC (Ala/A) | 2nd base C to T on coding strand | GTC (Val/V) |
| GCA (Ala/A) | 2nd base C to T on coding strand | GTA (Val/V) |
| GCG (Ala/A) | 2nd base C to T on coding strand | GTG (Val/V) |
| GCT (Ala/A) | 1st base C to T on complementary stand | ACT (Thr/T) |
| GCC (Ala/A) | 1st base C to T on complementary stand | ACC (Thr/T) |
| GCA (Ala/A) | 1st base C to T on complementary stand | ACA (Thr/T) |
| GCG (Ala/A) | 1st base C to T on complementary stand | ACG (Thr/T) |
| CAT (His/H) | 1st base C to T on complementary stand | TAT (Tyr/Y) |
| CAC (His/H) | 1st base C to T on complementary stand | TAC (Tyr/Y) |
| GAT (Asp/D) | 1st base C to T on complementary stand | AAT (Asp/N) |
| GAC (Asp/D) | 1st base C to T on complementary stand | AAC (Asp/N) |
| GAA (Glu/E) | 1st base C to T on complementary stand | AAA (Lys/K) |
| GAG (Glu/E) | 1st base C to T on complementary stand | AAG (Lys/K) |
| TGT (Cys/C) | 2nd base C to T on complementary stand | TAT (Tyr/Y) |
| TGC (Cys/C) | 2nd base C to T on complementary stand | TAC (Tyr/Y) |
| CGT (Arg/R) | 1st base C to T on coding strand | TGT (Cys/C) |
| CGC (Arg/R) | 1st base C to T on coding strand | TGC (Cys/C) |
| AGA (Arg/R) | 2nd base C to T on complementary stand | AAA (Lys/K) |
| AGG (Arg/R) | 2nd base C to T on complementary stand | AAG (Lys/K) |
| CGG (Arg/R) | 2nd base C to T on complementary stand | CAG (Gln/Q) |
| CGG (Arg/R) | 1st base C to T on coding strand | TGG (Trp/W) |
| GGT (Gly/G) | 2nd base C to T on complementary stand | GAT (Asp/D) |
| GGC (Gly/G) | 2nd base C to T on complementary stand | GAC (Asp/D) |
| GGA (Gly/G) | 2nd base C to T on complementary stand | GAA (Glu/E) |
| GGG (Gly/G) | 2nd base C to T on complementary stand | GAG (Glu/E) |
| GGT (Gly/G) | 1st base C to T on complementary stand | AGT (Ser/S) |
| GGC (Gly/G) | 1st base C to T on complementary stand | AGC (Ser/S) |
| GGA (Gly/G) | 1st base C to T on complementary stand | AGA (Arg/R) |
| GGG (Gly/G) | 1st base C to T on complementary stand | AGG (Arg/R) |

In some embodiments, nucleobase editor is guided by a guide nucleotide sequence to its target sequence that it binds. In some embodiments, the guide nucleotide sequence is a gRNA sequence. An gRNA typically comprises a tracrRNA framework allowing for Cas9 binding, and a guide sequence, which confers sequence specificity to fusion proteins disclosed herein. In some embodiments, the guide RNA comprises a structure 5'-[guide sequence]-guuuuagagcuagaaauagcaaguuaaaauaaaggcuaguccguuaucaacuugaaaaagugggcaccgagucggugcuuuuuu-3' (SEQ ID NO: 338), wherein the guide sequence comprises a sequence that is complementary to the target sequence. The guide sequence is typically about 20 nucleotides long. For example, the guide sequence may be 15-25 nucleotides long. In some embodiments, the guide sequence is 15, 16, 17, 18, 19, 20, 21, 22, 23, 24, or 25 nucleotides long. Such suitable guide RNA sequences typically comprise guide sequences that are complementary to a nucleic sequence within 50 (e.g., 50, 45, 40, 35, 30, 25, 20, 15, or 10) nucleotides upstream or downstream of the target nucleotide to be edited.

In some embodiments, at least 1 mutation is introduced into the ion channel-encoding polynucleotide. In some embodiments, at least 2, 3, 4, 5, 6, 7, 8, 9, 10 or more mutations are introduced into the ion channel-encoding polynucleotide.

Target sites for nucleobase editors in the SCN9A gene encoding the ion channel NaV1.7 are provided in Table 2. The mutations presented herein are for illustration purpose only and are not meant to be limiting.

TABLE 2

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P5L/S/F | CCT | YYT | GAUGGCAAUGUUGCCUCCCC | 339 | (CAG) | 20 (C14/15) | SpBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P5L/S/F | CCN | YYN | AUGGCAAUGU UGCCUCCCCC | 340 | (AGG) | 20 (C13/14) | SpBE3 |
| P5/6L/S/F | CCN | YYN | UGGCAAUGUU GCCUCCCCCA | 341 | (GGAC) | 20 (C12/13) | VQR-SpBE3 |
| P5/6L/S/F | CCN | YYN | UGUUGCCUCC CCCAGGACCU | 342 | (CAG) | 20 (C6/7) | SpBE3 |
| P5/6/7L/S/F | CCN | YYN | GUUGCCUCCC CCAGGACCUC | 343 | (AGAG) | 20 (C5/6) | EQR-SpBE3 |
| P5/6/7L7S/F | CCN | YYN | UUGCCUCCCC CAGGACCUCA | 344 | (GAG) | 20 (C4/5) | SpBE3 |
| P35L/S/F | CCC | YYC | AAAAUCAAAG | 345 | (AAG) | 20 (C14/15) | SpBE3 |
| P35L/S/F | CCC | YYC | GAACCCAAAG AAAUCAAAGG AACCCAAAGA | 346 | (AGAA) | 20 (C13/14) | VQR-SpBE3 |
| P35L/S/F | CCC | YYC | CAAAGGAACC CAAAGAAGAA | 347 | (AAG) | 20 (C9/10) | SpBE3 |
| P35LVS/F | CCC | YYC | AAAGGAACCC AAAGAAGAAA | 348 | (AGAA) | 20 (C8/9) | VQR-SpBE3 |
| P35L/S/F | CCC | YYC | GGAACCCAAA GAAGAAAAGA | 349 | (AAG) | 20 (C5/6) | SpBE3 |
| P35L/S/F | CCC | YYC | GAACCCAAAG AAGAAAAGAA | 350 | (AGAT) | 20 (C4/5) | VQR-SpBE3 |
| P35L7S/F | CCC | YYC | CCCAAAGAAG AAAAGAAAGA | 351 | (TGAT) | 20 (C1/2) | VQR-SpBE3 |
| P35L/S/F | CCC | YYC | AGGAACCCAA AGAAGAAAAG | 352 | (AAAGAT) | 20 (C6/7) | KKH-SaBE3 |
| P35L/S/F | CCC | YYC | AACCCAAAGA AGAAAAGAAA | 353 | (GATGAT) | 20 (C3/4) | KKH-SaBE3 |
| P35LVS/F | CCC | YYC | GAAAAUCAAA GGAACCCAAA | 354 | (GAAGAAA) | 20 (C15/16) | St1BE3 |
| P35LVS/F | CCC | YYC | UCAAAGGAAC CCAAAGAAGA | 355 | (AAAGAAA) | 20 (C10/11) | St1BE3 |
| P47L/S/F | CCA | YYA | GAUGAAGAAG CCCCAAAGCC | 356 | (AAG) | 20 (C13/14) | SpBE3 |
| P47L/S/F | CCA | YYA | GAAGAAGCCC CAAAGCCAAG | 357 | (CAG) | 20 (C10/11) | SpBE3 |
| P47L/S/F | CCA | YYA | AAGAAGCCCC AAAGCCAAGC | 358 | (AGTG) | 20 (C9/10) | VQR-SpBE3 |
| P47L/S/F | CCA | YYA | GAAGCCCCAA AGCCAAGCAG | 359 | (TGAC) | 20 (C7/8) | VQR-SpBE3 |
| P47/49L7S/F | CCA | YYA | CCCAAAGCCA AGCAGUGACU | 360 | (TGG) | 20 (C2/3/ 8/9) | SpBE3 |
| P47/49L/S/F | CCA | YYA | CCAAAGCCAA GCAGUGACUU | 361 | (GGAA) | 20 (C1/2/ 7/8) | VQR-SpBE3 |
| P47L/S/F | CCA | YYA | AUGAAGAAGC CCCAAAGCCA | 362 | (AGCAGT) | 20 (C12/13) | KKH-SaBE3 |
| P49LVS/F | CCA | YYA | AAAGCCAAGC AGUGACUUGG | 363 | (AAG) | 20 (C5/6) | SpBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type |
|---|---|---|---|---|---|---|---|
| P49L/S/F | CCA | YYA | CCAAGCAGUGACUUGGAAGC | 364 | (TGG) | 20 (C1/2) | SpBE3 |
| P60L/S/F | CCC | YYC | AAACAGCUGCCUUCAUCUA | 365 | (TGG) | 20 (C10/11) | SpBE3 |
| P60LVS/F | CCC | YYC | AACAGCUGCCCUUCAUCUAU | 366 | (GGG) | 20 (C9/10) | SpBE3 |
| P60LVS/F | CCC | YYC | ACAGCUGCCCUUCAUCUAUG | 367 | (GGG) | 20 (C8/9) | SpBE3 |
| P60L/S/F | CCC | YYC | CAGCUGCCCUUCAUCUAUGG | 368 | (GGAC) | 20 (C7/8) | VQR-SpBE3 |
| P60L7S/F | CCC | YYC | AAACAGCUGCCUUCAUCUA | 369 | (TGGGG) | 20 (C10/11) | St3BE3 |
| P67/8L/S/F | CCT | YYT | UGGGGACAUUCCUCCCGGCA | 370 | (TGG) | 20 (C1 1 -15) | SpBE3 |
| P67/8L7S/F | CCT | YYT | GGGGACAUUCCUCCCGGCAU | 371 | (GGTG) | 20 (C10-14) | VQR-SpBE3 |
| P67/8L/S/F | CCT | YYT | CAUUCCUCCCGGCAUGGUGU | 372 | (CAG) | 20 (C5-9) | SpBE3 |
| P67/8L/S/F | CCT | YYT | AUUCCUCCCGGCAUGGUGUC | 373 | (AGAG) | 20 (C4-8) | EQR*SpBE3 |
| P67/8L7S/F | CCT | YYT | UUCCUCCCGGCAUGGUGUCA | 374 | (GAG) | 20 (C3-7) | SpBE3 |
| P67L/S/F | CCT | YYT | UAUGGGGACAUUCCUCCCGG | 375 | (CATGGT) | 20 (C13-17) | KKH-SaBE3 |
| P67L/S/F | CCT | YYT | UGGGGACAUUCCUCCCGGCA | 376 | (TGGTG) | 20 (C11-15) | St3BE3 |
| P74L/S/F | CCC | YYC | CAUGGUGUCAGAGCCCCUGG | 377 | (AGG) | 20 (C14/15) | SpBE3 |
| P74LVS/F | CCC | YYC | AUGGUGUCAGAGCCCCUGGA | 378 | (GGAC) | 20 (C13/14) | VQR-SpBE3 |
| P74L/S/F | CCC | YYC | GUCAGAGCCCCUGGAGGACU | 379 | (TGG) | 20 (C8/9) | SpBE3 |
| P74L/S/F | CCC | YYC | UCAGAGCCCCUGGAGGACUU | 380 | (GGAC) | 20 (C7/8) | VQR-SpBE3 |
| P80L7S/F | CCC | YYC | GGACUUGGACCCCUACUAUG | 381 | (CAG) | 20 (C11/12) | SpBE3 |
| P80L/S/F | CCC | YYC | GACUUGGACCCCUACUAUGC | 382 | (AGAC) | 20 (C10/11) | VQR-SpBE3 |
| P80LVS/F | CCC | YYC | ACCCCUACUAUGCAGACAAA | 383 | (AAG) | 20 (C3/4) | SpBE3 |
| P80L/S/F | CCC | YYC | CCCCUACUAUGCAGACAAAA | 387 | (AGG) | 20 (C2/3) | SpBE3 |
| P80LVS/F | CCC | YYC | CCCUACUAUGCAGACAAAAA | 388 | (GGTG) | 20 (C1/2) | VQR-SpBE3 |
| P80LVS/F | CCC | YYC | GACCCCUACUAUGCAGACAA | 389 | (AAAGGT) | 20 (C4/5) | KKH-SaBE3 |
| P80L/S/F | CCC | YYC | CCCCUACUAUGCAGACAAAA | 390 | (AGGTG) | 20 (C2/3) | St3BE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P111L7S/F | CCT | YYT | CUUUCUCCUUUCAGUCCUCU | 391 | (AAG) | 20 (C7/8) | SpBE3 |
| P111L/S/F | CCT | YYT | UUUCUCCUUUCAGUCCUCUA | 392 | (AGAA) | 20 (C6/7) | VQR-SpBE3 |
| P111L7S/F | CCT | YYT | UCUCCUUUCAGUCCUCUAAG | 393 | (AAG) | 20 (C4/5) | SpBE3 |
| P111/4L/S/F | CCT | YYT | CUCCUUUCAGUCCUCUAAGA | 394 | (AGAA) | 20 (C3/4/12) | VQR-SpBE3 |
| P111L/S/F | CCT | YYT | UCUCCUUUCAGUCCUCUAAG | 395 | (AAGAAT) | 20 (C4/5) | SaBE3 |
| P111L/S/F | CCT | YYT | GCUUUCUCCUUUCAGUCCUC | 396 | (TAAGAAG) | 20 (C8/9) | St1BE3 |
| P111L/S/F | CCT | YYT | UUCUCCUUUCAGUCCUCUAA | 397 | (GAAGAAT) | 20 (C5/6) | St1BE3 |
| P114L/S/F | CCT | YYT | CCUCUAAGAAGAAUAUCUAU | 398 | (TAAGAT) | 20 (C1/2/12) | KKH-SaBE3 |
| C134Y | TGC | TAC | AGUGCACAUGAUGAGCAUGC | 399 | (TGAA) | 20 (C5) | VQR-SpBE3 |
| C134Y | TGC | TAC | GUCAGAAUAGUGCACAUGAU | 400 | (GAG) | 20 (C13) | SpBE3 |
| C134Y | TGC | TAC | CACAUGAUGAGCAUGCUGAA | 401 | (TAAGGT) | 20 (C1) | KKH-SaBE3 |
| C134Y | TGC | TAC | UAGUGCACAUGAUGAGCAUG | 402 | (CTGAAT) | 20 (C6) | SaBE3 |
| C140Y | TGC | TAC | AAUAUGCAGUUUGUCAGAAU | 403 | (AGTG) | 20 (C7) | VQR-SpBE3 |
| C140Y | TGC | TAC | AAAUAUGCAGUUUGUCAGAA | 404 | (TAG) | 20 (C8) | SpBE3 |
| C140Y | TGC | TAC | UCAUAAAUAUGCAGUUUGUC | 405 | (AGAA) | 20 (C12) | VQR-SpBE3 |
| C140Y | TGC | TAC | GUCAUAAAUAUGCAGUUUGU | 406 | (CAG) | 20 (C13) | SpBE3 |
| C140Y | TGC | TAC | CAGUUUGUCAGAAUAGUGCA | 407 | (CATGAT) | 20 (C1) | KKH-SaBE3 |
| C140Y | TGC | TAC | AUAAAUAUGCAGUUUGUCAG | 408 | (AATAGT) | 20 (C10) | KKH-SaBE3 |
| C140Y | TGC | TAC | GUCAUAAAUAUGCAGUUUGU | 409 | (CAGAAT) | 20 (C13) | SaBE3 |
| C140Y | TGC | TAC | GGUCAUAAAUAUGCAGUUUG | 410 | (TCAGAAT) | 20 (C14) | St1BE3 |
| P148L7S/F | CCA | YYA | CCAUGAAUAACCCACCGGAC | 411 | (TGG) | 20 (C12/13) | SpBE3 |
| P148L7S/F | CCA | YYA | CAUGAAUAACCCACCGGACU | 412 | (GGAC) | 20 (C11/12) | VQR-SpBE3 |
| P148L/S/F | CCA | YYA | AUAACCCACCGGACUGGACC | 413 | (AAAAAT) | 20 (C6-10) | KKH-SaBE3 |
| P149US/F | CCG | YYG | ACCGGACUGGACCAAAAAUG | 414 | (TCGAGT) | 20 (C2/3) | SaBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| G161R | GGA | ARR | AAAGUAUAUA UUCCAGUAAA | 415 | (AGTG) | 20 (C13) | VQR-SpBE3 |
| G161R | GGA | ARR | UCAAAAGUAU AUAUUCCAGU | 416 | (AAAAGT) | 20 (C16) | KKH-SaBE3 |
| G179R | GGA | ARR | CUACACAGAA GCCUCUUGCA | 417 | (AGG) | 20 (C-1) | SpBE3 |
| G179R | GGA | ARR | CCUACACAGA AGCCUCUUGC | 418 | (AAG) | 20 (C1) | SpBE3 |
| G179R | GGA | ARR | AAGUGAAUUC UCCUACACAG | 419 | (AAG) | 20 (C12) | SpBE3 |
| G179R | GGA | ARR | AAAAGUGAAU UCUCCUACAC | 420 | (AGAA) | 20 (C14) | VQR-SpBE3 |
| G179R | GGA | ARR | CCUACACAGA AGCCUCUUGC | 421 | (AAGGAT) | 20 (C1) | SaBE3 |
| G179R | GGA | ARR | AGAAAAGUGA AUUCUCCUAC | 422 | (ACAGAAG) | 20 (C16) | St1BE3 |
| P187L/S/F | CCG | YYG | UUCUUCGUGA CCCGUGGAAC | 423 | (TGG) | 20 (C12/13) | SpBE3 |
| P187L/S/F | CCG | YYG | UCGUGACCCG UGGAACUGGC | 424 | (TGG) | 20 (C8/9) | SpBE3 |
| P187L/S/F | CCG | YYG | CGUGACCCGU GGAACUGGCU | 425 | (GGAT) | 20 (C7/8) | VQR-SpBE3 |
| P187L/S/F | CCG | YYG | UUCGUGACCC GUGGAACUGG | 426 | (CTGGAT) | 20 (C9/10) | SaBE3 |
| P229L/S/F | CCA | YYA | UUUCUGUAAU CCCAGGUAAG | 427 | (AAG) | 20 (C12/13) | SpBE3 |
| P229L/S/F | CCA | YYA | AAUCCCAGGU AAGAAGUAAU | 428 | (TGG) | 20 (C5/6) | SpBE3 |
| P229L/S/F | CCA | YYA | AUCCCAGGUA AGAAGUAAUU | 429 | (GGTG) | 20 (C4/5) | VQR-SpBE3 |
| P229L/S/F | CCA | YYA | CCCAGGUAAG AAGUAAUUGG | 430 | (TGTG) | 20 (C2/3) | VQR-SpBE3 |
| P229L/S/F | CCA | YYA | UAUUUCUGUA AUCCCAGGUA | 431 | (AGAAGT) | 20 (C14/15) | KKH-SaBE3 |
| P229L/S/F | CCA | YYA | UUCUGUAAUC CCAGGUAAGA | 432 | (AGTAAT) | 20 (C11/12) | KKH-SaBE3 |
| P229L/S/F | CCA | YYA | GUAAUCCCAG GUAAGAAGUA | 433 | (ATTGGT) | 20 (C7/8) | KKH-SaBE3 |
| P229L/S/F | CCA | YYA | AAUCCCAGGU AAGAAGUAAU | 434 | (TGGTG) | 20 (C5/6) | St3BE3 |
| G236R | GGG | ARR | CCUACAAUUG UCUUCAGGCC | 435 | (TGAA) | 20 (C1) | VQR-SpBE3 |
| G236R | GGG | ARR | AAGCCCCUAC AAUUGUCUUC | 436 | (AGG) | 20 (C6) | SpBE3 |
| G236R | GGG | ARR | AAAGCCCCUA CAAUUGUCUU | 437 | (CAG) | 20 (C7) | SpBE3 |
| G236R | GGG | ARR | CUACAAUUGU CUUCAGGCCU | 438 | (GAAAAT) | 20 (C-1) | KKH-SaBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| C255Y | TGT | TAT | ACAGAACACAGUCAGGAUCA | 439 | (TGAC) | 20 (C2) | VQR-SpBE3 |
| C255Y | TGT | TAT | ACUCAGACAGAACACAGUCA | 440 | (GGAT) | 20 (C8) | VQR-SpBE3 |
| C255Y | TGT | TAT | CACUCAGACAGAACACAGUC | 441 | (AGG) | 20 (C9) | SpBE3 |
| C255Y | TGT | TAT | ACACUCAGACAGAACACAGU | 442 | (CAG) | 20 (C10) | SpBE3 |
| C255Y | TGT | TAT | ACACUCAGACAGAACACAGU | 443 | (CAGGAT) | 20 (C10) | SaBE3 |
| G263R | GGA | ARR | CAAUUAGUGCAAACACACUC | 444 | (AGAC) | 20 (C-1) | VQR-SpBE3 |
| G263R | GGA | ARR | CCAAUUAGUGCAAACACACU | 445 | (CAG) | 20 (C1) | SpBE3 |
| C275Y | TGT | TAT | UUCGAAAACAUUUAUGCUUC | 446 | (AGG) | 20 (C9) | SpBE3 |
| C275Y | TGT | TAT | UUUCGAAAACAUUUAUGCUU | 447 | (CAG) | 20 (C10) | SpBE3 |
| C275Y | TGT | TAT | AUUUCGAAAACAUUUAUGCU | 448 | (TCAGGT) | 20 (C11) | KKH-SaBE3 |
| C315Y | TGT | TAT | CCACAAAGGAGAGCAUCUUU | 449 | (GGAT) | 20 (C4) | VQR-SpBE3 |
| C315Y | TGT | TAT | ACCACAAAGGAGAGCAUCUU | 450 | (TGG) | 20 (C5) | SpBE3 |
| C315Y | TGT | TAT | UGUGCUGAAACCACAAAGGA | 451 | (GAG) | 20 (C14) | SpBE3 |
| C315Y | TGT | TAT | AACCACAAAGGAGAGCAUCU | 452 | (TTGGAT) | 20 (C6) | SaBE3 |
| C324Y | TGT | TAT | ACACUGACUACACACGAGAA | 453 | (AGAA) | 20 (C2) | VQR-SpBE3 |
| C324Y | TGT | TAT | GACACUGACUACACACGAGA | 454 | (AAG) | 20 (C3) | SpBE3 |
| C324Y | TGT | TAT | CUGGACACUGACUACACACG | 455 | (AGAA) | 20 (C6) | VQR-SpBE3 |
| C324Y | TGT | TAT | UCUGGACACUGACUACACAC | 456 | (GAG) | 20 (C7) | SpBE3 |
| C324Y | TGT | TAT | GGACACUGACUACACACGAG | 457 | (AAAGAAC) | 20 (C4) | St1BE3 |
| C324Y | TGT | TAT | CUCUGGACACUGACUACACA | 458 | (CGAGAAA) | 20 (C8) | St1BE3 |
| C325Y | TGT | TAT | CUCUGGACACUGACUACACA | 459 | (CGAG) | 20 (C8) | EQR-SpBE3 |
| P325L/S/F | CCA | YYA | AGUGUCCAGAGGGGUACACC | 460 | (TGTG) | 20 (C6/7) | VQR-SpBE3 |
| P325L/S/F | CCA | YYA | UGUCCAGAGGGGUACACCUG | 461 | (TGTG) | 20 (C4/5) | VQR-SpBE3 |
| P325LVS/F | CCA | YYA | UCCAGAGGGGUACACCUGUG | 462 | (TGAA) | 20 (C2/3) | VQR-SpBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P325L/S/F | CCA | YYA | CCAGAGGGGU ACACCUGUGU | 463 | (GAAAAT) | 20 (C1/2) | KKH-SaBE3 |
| C330Y | TGT | TAT | AGGUGUACCC CUCUGGACAC | 464 | (TGAC) | 20 (C-1) | VQR-SpBE3 |
| C330Y | TGT | TAT | UCACACAGGU GUACCCCUCU | 465 | (GGAC) | 20 (C6) | VQR-SpBE3 |
| C330Y | TGT | TAT | UUCACACAGG UGUACCCCUC | 466 | (TGG) | 20 (C7) | SpBE3 |
| P337L/S/F | CCT | YYT | AUUGGCAGAA ACCCUGAUUA | 467 | (TGG) | 20 (C13/14) | SpBE3 |
| P337L/S/F | CCT | YYT | AAACCCUGAU UAUGGCUACA | 468 | (CGAG) | 20 (C5/6) | EQR-SpBE3 |
| P337L/S/F | CCT | YYT | AACCCUGAUU AUGGCUACAC | 469 | (GAG) | 20 (C4/5) | SpBE3 |
| P532L/S/F | CCC | YYC | UACCCCCAAU CAGGUACCAC | 470 | (CCAAAT) | 20 (C5/6) | KKH-SaBE3 |
| P536L/S/F | CCA | YYA | UGCAGUCACC ACUCAGCAUU | 471 | (CGTG) | 20 (C9/10) | VQR-SpBE3 |
| P536L/S/F | CCA | YYA | CAGUCACCAC UCAGCAUUCG | 472 | (TGG) | 20 (C7/8) | SpBE3 |
| P591L/S/F | CCC | YYC | GCUCACUGUU UGUGCCCCAC | 473 | (AGAC) | 20 (C15/16) | VQR-SpBE3 |
| P591L/S/F | CCC | YYC | UGUUUGUGCC CCACAGACCC | 474 | (CAG) | 20 (C9/10) | SpBE3 |
| P591L7S/F | CCC | YYC | GUUUGUGCCC CACAGACCCC | 475 | (AGG) | 20 (Ca8/9) | SpBE3 |
| P591L/S/F | CCC | YYC | UUUGUGCCCC ACAGACCCCA | 476 | (GGAG) | 20 (C7/8) | EQR-SpBE3 |
| P591L/S/F | CCC | YYC | UUGUGCCCCA CAGACCCCAG | 477 | (GAG) | 20 (C6/7) | SpBE3 |
| P591L/S/F | CCC | YYC | UGUGCCCCAC AGACCCCAGG | 478 | (AGCG) | 20 (C5/6) | VRER-SpBE3 |
| P591L/S/F | CCC | YYC | UGCCCCACAG ACCCCAGGAG | 479 | (CGAC) | 20 (C3/4/12) | VQR-SpBE3 |
| P591L/S/F | CCC | YYC | GUUUGUGCCC CACAGACCCC | 480 | (AGGAG) | 20 (C8/9) | St3BE3 |
| P594L7S/F | CCC | YYC | CACAGACCCC AGGAGCGACG | 481 | (CAG) | 20 (C7/8) | SpBE3 |
| P594LVS/F | CCC | YYC | AGACCCCAGG AGCGACGCAG | 482 | (CAG) | 20 (C4/5) | SpBE3 |
| P594L7S/F | CCC | YYC | ACAGACCCCA GGAGCGACGC | 483 | (AGCAGT) | 20 (C6/7) | KKH-SaBE3 |
| P609/10L/S/F | CCA | YYA | UAGGUCCCCA CCAAUGCUGC | 484 | (CGG) | 20 (C8-12) | SpBE3 |
| P609/10L/S/F | CCA | YYA | AGGUCCCCAC CAAUGCUGCC | 485 | (GGTG) | 20 (C7-11) | VQR-SpBE3 |
| P609/10L/S/F | CCA | YYA | GUCCCCACCA AUGCUGCCGG | 486 | (TGAA) | 20 (C5-9) | VQR-SpBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P609/10L/S/F | CCA | YYA | CCACCAAUGCUGCCGGUGAA | 487 | (CGG) | 20 (C1-4) | SpBE3 |
| P609/10L/S/F | CCA | YYA | AGUACCUCCCCACCAAUGCU | 488 | (GCCGGT) | 20 (C10-14) | KKH-SaBE3 |
| P609/10L7S/F | CCA | YYA | UAGGUCCCCACCAAUGCUGC | 489 | (CGGTG) | 20 (C8-12) | St3BE3 |
| P610L/S/F | CCA | YYA | CACCAAUGCUGCCGGUGAAC | 490 | (GGG) | 20 (C3/4) | SpBE3 |
| P610L/S/F | CCA | YYA | ACCAAUGCUGCCGGUGAACG | 491 | (GGAA) | 20 (C2/3) | VQR-SpBE3 |
| P613L7S/F | CCG | YYG | CACCAAUGCUGCCGGUGAAC | 492 | (GGG) | 20 (C12/13) | SpBE3 |
| P613L7S/F | CCG | YYG | ACCAAUGCUGCCGGUGAACG | 493 | (GGAA) | 20 (C11/12) | VQR-SpBE3 |
| P613L/S/F | CCG | YYG | CCGGUGAACGGGAAAAUGCA | 494 | (CAG) | 20 (C1/2) | SpBE3 |
| P613L7S/F | CCG | YYG | CCAAUGCUGCCGGUGAACGG | 495 | (GAAAAT) | 20 (C10/11) | KKH-SaBE3 |
| P640L/S/F | CCC | YYC | CCCUCAUGCUCCCCAAUGGA | 496 | (CAG) | 20 (C12/13) | SpBE3 |
| P640US/F | CCC | YYC | CCCCAAUGGACAGCUUCUGC | 497 | (CAG) | 20 (C2/3) | SpBE3 |
| P640L7S/F | CCC | YYC | CCCAAUGGACAGCUUCUGCC | 498 | (AGAG) | 20 (C1/2) | EQR-SpBE3 |
| P640L/S/F | CCC | YYC | CCCAAUGGACAGCUUCUGCC | 499 | (AGAGGT) | 20 (C1/2) | KKH-SaBE3 |
| P646L7S/F | CCA | YYA | GCUUCUGCCAGAGGUGAUAA | 500 | (TAG) | 20 (C8/9) | SpBE3 |
| P646L7S/F | CCA | YYA | CUUCUGCCAGAGGUGAUAAU | 501 | (AGAT) | 20 (C7/8) | VQR-SpBE3 |
| P646L/S/F | CCA | YYA | UGCCAGAGGUGAUAAUAGAU | 502 | (AAG) | 20 (C3/4) | SpBE3 |
| P646L7S/F | CCA | YYA | GCCAGAGGUGAUAAUAGAUA | 503 | (AGG) | 20 (C2/3) | SpBE3 |
| P646L/S/F | CCA | YYA | GGACAGCUUCUGCCAGAGGU | 504 | (GATAAT) | 20 (C13/14) | KKH-SaBE3 |
| P646L/S/F | CCA | YYA | AGCUUCUGCCAGAGGUGAUA | 505 | (ATAGAT) | 20 (C9/10) | KKH-SaBE3 |
| P683L7S/F | CCC | YYC | AUGCUGAAUGAUCCCAACCU | 506 | (CAG) | 20 (C13/14) | SpBE3 |
| P683L/S/F | CCC | YYC | UGCUGAAUGAUCCCAACCUC | 507 | (AGAC) | 20 (02/13) | VQR-SpBE3 |
| P683LVS/F | CCC | YYC | UGAAUGAUCCCAACCUCAGA | 508 | (CAG) | 20 (C9/10) | SpBE3 |
| P683L7S/F | CCC | YYC | GAAUGAUCCCAACCUCAGAC | 509 | (AGAG) | 20 (C8/9) | EQR-SpBE3 |
| P683L/S/F | CCC | YYC | AAUGAUCCCAACCUCAGACA | 510 | (GAG) | 20 (C7/8) | SpBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P683L7S/F | CCC | YYC | AUGAUCCCAA CCUCAGACAG | 511 | (AGAG) | 20 (C6/7) | EQR-SpBE3 |
| P683L7S/F | CCC | YYC | UGAUCCCAAC CUCAGACAGA | 512 | (GAG) | 20 (C5/6) | SpBE3 |
| P683L/S/F | CCC | YYC | GAUCCCAACC UCAGACAGAG | 513 | (AGCAAT) | 20 (C4/5) | KKH-SaBE3 |
| P711US/F | CCA | YYA | CAGACAAAAA UGUCCACCUU | 514 | (GGTG) | 20 (04/15) | VQR-SpBE3 |
| P711US/F | CCA | YYA | GACAAAAAUG UCCACCUUGG | 515 | (TGG) | 20 (02/13) | SpBE3 |
| P711/2L/S/F | CCA | YYA | AAAUGUCCAC CUUGGUGGUA | 516 | (CAG) | 20 (C7-11) | SpBE3 |
| P711/2L/S/F | CCA | YYA | AAUGUCCACC UUGGUGGUAC | 517 | (AGAT) | 20 (C6-10) | VQR-SpBE3 |
| P711LVS/F | CCA | YYA | CAGACAAAAA UGUCCACCUU | 518 | (GGTGGT) | 20 (04/15) | KKH-SaBE3 |
| P711/2L/S/F | CCA | YYA | AAAUGUCCA CCUUGGUGGU | 519 | (ACAGAT) | 20 (C8-12) | KKH-SaBE3 |
| P711L7S/F | CCA | YYA | CCAGACAAAA AUGUCCACCU | 520 | (TGGTG) | 20 (C15/16) | St3BE3 |
| P728L/S/F | CCA | YYA | GAAUUGCUCU CCAUAUUGGA | 521 | (TAAAAT) | 20 (C11/12) | KKH-SaBE3 |
| P728L/S/F | CCA | YYA | UCCAUAUUGG AUAAAAUUCA | 522 | (AAAAGT) | 20 (C2/3) | KKH-SaBE3 |
| P744L/S/F | CCT | YYT | AUUGUAAUGG AUCCUUUUGU | 523 | (AGAT) | 20 (C13/14) | VQR-SpBE3 |
| P744L/S/F | CCT | YYT | UUAUUGUAAU GGAUCCUUUU | 524 | (GTAGAT) | 20 (C15/16) | KKH-SaBE3 |
| P744L/S/F | CCT | YYT | AUGGAUCCUU UUGUAGAUCU | 525 | (TGCAAT) | 20 (C7/8) | KKH-SaBE3 |
| C753V | TGC | TAC | CUAUGCAAAU GGUAAUUGCA | 526 | (AGAT) | 20 (C6) | VQR-SpBE3 |
| C753Y | TGC | TAC | ACUAUGCAAA UGGUAAUUGC | 527 | (AAG) | 20 (C7) | SpBE3 |
| C753Y | TGC | TAC | AACUAUGCAA AUGGUAAUUG | 528 | (CAAGAT) | 20 (C8) | KKH-SaBE3 |
| P767L/S/F | CCA | YYA | AUGGAACACC ACCCAAUGAC | 529 | (TGAG) | 20 (C13/14) | EQR-SpBE3 |
| P767L/S/F | CCA | YYA | UGGAACACCA CCCAAUGACU | 530 | (GAG) | 20 (C12/13) | SpBE3 |
| P767L/S/F | CCA | YYA | GGAACACCAC CCAAUGACUG | 531 | (AGG) | 20 (C11/12) | SpBE3 |
| P767US/F | CCA | YYA | GAACACCACC CAAUGACUGA | 532 | (GGAA) | 20 (C10/11) | VQR-SpBE3 |
| P767L/S/F | CCA | YYA | GGAACACCAC CCAAUGACUG | 533 | (AGGAAT) | 20 (C11/12) | SaBE3 |
| P767LVS/F | CCA | YYA | ACCCAAUGAC UGAGGAAUUC | 534 | (AAAAAT) | 20 (C3/4) | KKH-SaBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| G779R | GGA | ARR | UCCUAUAGCAAGUACAUUUU | 535 | (TGAA) | 20 (C2) | VQR-SpBE3 |
| G779R | GGA | ARR | CUUACCAAAUUUCCUAUAGC | 536 | (AAG) | 20 (C13) | SpBE3 |
| G779R | GGA | ARR | UUCCUAUAGCAAGUACAUUU | 537 | (TTGAAT) | 20 (C3) | SaBE3 |
| G779R | GGA | ARR | GACUUACCAAAUUUCCUAUA | 538 | (GCAAGT) | 20 (C15) | KKH-SaBE3 |
| G785R | GGA | ARR | UUCCAGUAAAGACCUAAGUG | 539 | (AGAA) | 20 (C3) | VQR-SpBE3 |
| G785R | GGA | ARR | AUUCCAGUAAAGACCUAAGU | 540 | (GAG) | 20 (C4) | SpBE3 |
| G785R | GGA | ARA | AAGAUUCCAGUAAAGACCUA | 541 | (AGTG) | 20 (C7) | VQR-SpBE3 |
| G785R | GGA | ARA | AAAGAUUCCAGUAAAGACCU | 542 | (AAG) | 20 (C8) | SpBE3 |
| G785R | GGA | ARA | AGCUGCAAAGAUUCCAGUAA | 543 | (AGAC) | 20 (C14) | VQR-SpBE3 |
| G785R | GGA | ARA | CCAGUAAAGACCUAAGUGAG | 544 | (AAAAAT) | 20 (C1) | KKH-SaBE3 |
| G785R | GGA | ARA | GCAAAGAUUCCAGUAAAGAC | 545 | (CTAAGT) | 20 (C10) | KKH-SaBE3 |
| G785R | GGA | ARA | GAUUCCAGUAAAGACCUAAG | 546 | (TGAGAAA) | 20 (C5) | St1BE3 |
| G786R | GGA | ARR | GAUUCCAGUAAAGACCUAAG | 547 | (TGAG) | 20 (C5) | EQR-SpBE3 |
| P800US/F | CCA | YYA | GGAUCCAUAUGAGUAUUUCC | 548 | (AAG) | 20 (C5/6) | SpBE3 |
| P800L/S/F | CCA | YYA | UCCAUAUGAGUAUUUCCAAG | 549 | (TAG) | 20 (C2/3) | SpBE3 |
| P800L/S/F | CCA | YYA | CCAUAUGAGUAUUUCCAAGU | 550 | (AGG) | 20 (C1/2) | SpBE3 |
| P800L7S/F | CCA | YYA | AUGGAUCCAUAUGAGUAUUU | 551 | (CCAAGT) | 20 (C7/8) | KKH-SaBE3 |
| G830R | GGA | ARA | CCUUCCACAUCUGCUAGAAA | 552 | (GAG) | 20 (C1) | SpBE3 |
| G830R | GGA | ARA | AUCCUUCCACAUCUGCUAGA | 553 | (AAG) | 20 (C3) | SpBE3 |
| G830R | GGA | ARA | ACAAUCCUUCCACAUCUGCU | 554 | (AGAA) | 20 (C6) | VQR-SpBE3 |
| G830R | GGA | ARA | GACAAUCCUUCCACAUCUGC | 555 | (TAG) | 20 (C7) | SpBE3 |
| G830R | GGA | ARA | UGACAAUCCUUCCACAUCUG | 556 | (CTAGAAA) | 20 (C8) | St1BE3 |
| G831R | GGA | ARA | UCCUUCCACAUCUGCUAGAA | 557 | (AGAG) | 20 (C2) | EQR-SpBE3 |
| P850US/F | CCA | YYA | CUGGCCAACAUUGAACAUGC | 558 | (TGAT) | 20 (C5/6) | VQR-SpBE3 |

TABLE 2-continued

Exemplary NaV1.7 (SNA9A) Protective Loss-of-Function Mutations via Codon Changes

| Residue Change | Codon Change | Resulting Codon(

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P983L7S/F | CCT | YYT | ACCCUGAUGCAAACAACCUC | 582 | (CAG) | 20 (C3/4) | SpBE3 |
| P983L7S/F | CCT | YYT | CCCUGAUGCAACAACCUCC | 583 | (AGAT) | 20 (C2/3) | VQR-SpBE3 |
| P983L/S/F | CCT | YYT | GACCCUGAUGCAAACAACCU | 584 | (CCAGAT) | 20 (C4/5) | KKH-SaBE3 |
| P1018LVS/F | CCA | YYA | UCCAAAAGCCAAAGAUUUC | 585 | (CAG) | 20 (C10/11) | SpBE3 |
| P1018LVS/F | CCA | YYA | CCAAAAGCCAAAGAUUUCC | 586 | (AGG) | 20 (C9/10) | SpBE3 |
| P1018LVS/F | CCA | YYA | CAAAAGCCAAGAUUUCCA | 587 | (GGG) | 20 (C8/9) | SpBE3 |
| P1018L7S/F | CCA | YYA | AAAAAGCCAAAGAUUUCCAG | 588 | (GGAG) | 20 (C7/8) | EQR-SpBE3 |
| P1018L7S/F | CCA | YYA | AAAAGCCAAAGAUUUCCAGG | 589 | (GAG) | 20 (C6/7) | SpBE3 |
| P1018LVS/F | CCA | YYA | AAAGCCAAAGAUUUCCAGGG | 590 | (AGAT) | 20 (C5/6) | VQR-SpBE3 |
| P1018LVS/F | CCA | YYA | CCAAAGAUUUCCAGGGAGAU | 591 | (AAG) | 20 (C1/2) | SpBE3 |
| P1018LVS/F | CCA | YYA | AAAAAGCCAAAGAUUUCCAG | 592 | (GGAGAT) | 20 (C7/8) | KKH-SaBE3 |
| P1018LVS/F | CCA | YYA | CAAAAGCCAAAGAUUUCCA | 593 | (GGGAG) | 20 (C8/9) | St3BE3 |
| P1083L7S/F | CCC | YYC | UAUUCACAAUCCCAGCCUCA | 594 | (CAG) | 20 (C11/12) | SpBE3 |
| P1083LVS/F | CCC | YYC | AUUCACAAUCCCAGCCUCAC | 595 | (AGTG) | 20 (C10/11) | VQR-SpBE3 |
| P1083L7S/F | CCC | YYC | UCACAAUCCCAGCCUCACAG | 596 | (TGAC) | 20 (C8/9) | VQR-SpBE3 |
| P1083LVS/F | CCC | YYC | CAAUCCCAGCCUCACAGUGA | 597 | (CAG) | 20 (C5/6) | SpBE3 |
| P1083L/S/F | CCC | YYC | AAUCCCAGCCUCACAGUGAC | 598 | (AGTG) | 20 (C4/5) | VQR-SpBE3 |
| P1083L7S/F | CCC | YYC | UUUAUUCACAAUCCCAGCCU | 599 | (CACAGT) | 20 (C13/14) | KKH-SaBE3 |
| P1083L/S/F | CCC | YYC | CACAAUCCCAGCCUCACAGU | 600 | (GACAGT) | 20 (C7/8) | KKH-SaBE3 |
| P1083L/S/F | CCC | YYC | CCCAGCCUCACAGUGACAGU | 601 | (GCCAAT) | 20 (C1/2) | KKH-SaBE3 |
| P1090US/F | CCA | YYA | GUGACAGUGCCAAUUGCACC | 602 | (TGG) | 20 (C10/11) | SpBE3 |
| P1090LVS/F | CCA | YYA | UGACACUCCCAAUUGCACCU | 603 | (GGG) | 20 (C9/10) | SpBE3 |
| P1090L7S/F | CCA | YYA | GACAGUGCCAAUUGCACCUG | 604 | (GGG) | 20 (C8/9) | SpBE3 |
| P1090L/S/F | CCA | YYA | ACACUGCCAAUUGCACCUGG | 605 | (GGAA) | 20 (C7/8) | VQR-SpBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P1090/3L/S/F | CCA | YYA | CCAAUUGCACCUGGGGAAUC | 606 | (CGAT) | 20 (C1/2/10/11) | VQR-SpBE3 |
| P1090L/S/F | CCA | YYA | GACAGUGCCAAUUGCACCUG | 607 | (GGGAAT) | 20 (C8/9) | SaBE3 |
| P1090/3L/S/F | CCA | YYA | UGCCAAUUGCACCUGGGGAA | 608 | (TCCGAT) | 20 (C3/4/13) | KKH-SaBE3 |
| P1090L7S/F | CCA | YYA | GUGACAGUGCCAAUUGCACC | 609 | (TGGGG) | 20 (C10/11) | St3BE3 |
| P1093L/S/F | CCT | YYT | UGCACCUGGGGAAUCCGAUU | 610 | (TGG) | 20 (C5/6) | SpBE3 |
| P1093L/S/F | CCT | YYT | GCACCUGGGGAAUCCGAUUU | 611 | (GGAA) | 20 (C4/5) | VQR-SpBE3 |
| P1093L/S/F | CCT | YYT | CACCUGGGGAAUCCGAUUUG | 612 | (GAAAAT) | 20 (C3/4) | KKH-SaBE3 |
| P1133L/S/F | CCT | YYT | ACAGUUGAUAACCCUUUGCC | 613 | (TGG) | 20 (C13/14) | SpBE3 |
| P1133L/S/F | CCT | YYT | CAGUUGAUAACCCUUUGCCU | 614 | (GGAG) | 20 (C1 2/13) | EQR-SpBE3 |
| P1133L/S/F | CCT | YYT | AGUUGAUAACCCUUUGCCUG | 615 | (GAG) | 20 (C11/12) | SpBE3 |
| P1133L7S/F | CCT | YYT | GUUGAUAACCCUUUGCCUGG | 616 | (AGAA) | 20 (C10/11) | VQR-SpBE3 |
| P1133/5L/S/F | CCT | YYT | UGAUAACCCUUUGCCUGGAG | 617 | (AAG) | 20 (C8-14) | SpBE3 |
| P1133/5L/S/F | CCT | YYT | GAUAACCCUUUGCCUGGAGA | 618 | (AGG) | 20 (C7-14) | SpBE3 |
| P1133/5L/S/F | CCT | YYT | AUAACCCUUUGCCUGGAGAA | 619 | (GGAG) | 20 (C6-13) | EQR-SpBE3 |
| P1133/5L/S/F | CCT | YYT | UAACCCUUUGCCUGGAGAAG | 620 | (GAG) | 20 (C5-12) | SpBE3 |
| P1133/5L/S/F | CCT | YYT | AACCCUUUGCCUGGAGAAGG | 621 | (AGAA) | 20 (C4-11) | VQR-SpBE3 |
| P1133/5L/S/F | CCT | YYT | CCCUUUGCCUGGAGAAGGAG | 622 | (AAG) | 20 (C2-9) | SpBE3 |
| P1133/5L/S/F | CCT | YYT | CCUUUGCCUGGAGAAGGAGA | 623 | (AGAA) | 20 (C1-8) | VQR-SpBE3 |
| P1133/5L/S/F | CCT | YYT | ACAGUUGAUAACCCUUUGCC | 624 | (TGGAG) | 20 (C13/14) | St3BE3 |
| P1133/5L/S/F | CCT | YYT | CAGUUGAUAACCCUUUGCCU | 625 | (GGAGAAG) | 20 (C12/13) | SHBE3 |
| P1133/5L/S/F | CCT | YYT | GAUAACCCUUUGCCUGGAGA | 626 | (AGGAG) | 20 (C7-14) | St3BE3 |
| P1133/5L/S/F | CCT | YYT | AUAACCCUUUGCCUGGAGAA | 627 | (GGAGAAG) | 20 (C6-13) | St1BE3 |
| P1133/5L/S/F | CCT | YYT | ACCCUUUGCCUGGAGAAGGA | 628 | (GAAGAAG) | 20 (C3-10) | St1BE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P1135L/S/F | CCT | YYT | UUUGCCUGGAGAAGGAGAAG | 629 | (AAG) | 20 (C5/6) | SpBE3 |
| P1135LVS/F | CCT | YYT | GCCUGGAGAAGGAGAAGAAG | 630 | (CAG) | 20 (C2/3) | SpBE3 |
| P1135IVS/F | CCT | YYT | CCUGGAGAAGGAGAAGAAGC | 631 | (AGAG) | 20 (C1/2) | EQR-SpBE3 |
| P1145L7S/F | CCT | YYT | GAGGCUGAACCUAUGAAUUC | 632 | (CGAT) | 20 (C10/11) | VQR-SpBE3 |
| P1145US/F | CCT | YYT | GCUGAACCUAUGAAUUCCGA | 633 | (TGAG) | 20 (C7/8) | EQR-SpBE3 |
| P1145L7S/F | CCT | YYT | CUGAACCUAUGAAUUCCGAU | 634 | (GAG) | 20 (C6/7) | SpBE3 |
| P1145LVS/F | CCT | YYT | ACCUAUGAAUUCCGAUGAGC | 635 | (CAG) | 20 (C2/3) | SpBE3 |
| P1145LVS/F | CCT | YYT | CCUAUGAAUUCCGAUGAGCC | 636 | (AGAG) | 20 (C1/2) | EQR-SpBE3 |
| P1145LVS/F | CCT | YYT | CAGAGGCUGAACCUAUGAAU | 637 | (TCCGAT) | 20 (C12/13) | KKH-SaBE3 |
| P1151L/S/F | CCA | YYA | UGAGCCAGAGGCCUGUUUCA | 638 | (CAG) | 20 (C5/6) | SpBE3 |
| P1151LVS/F | CCA | YYA | GAGCCAGAGGCCUGUUUCAC | 639 | (AGAT) | 20 (C4/5) | VQR-SpBE3 |
| P1151LVS/F | CCA | YYA | CCAGAGGCCUGUUUCACAGA | 640 | (TGG) | 20 (C1/2) | SpBE3 |
| P1151LVS/F | CCA | YYA | AUGAGCCAGAGGCCUGUUUC | 641 | (ACAGAT) | 20 (C6/7) | KKH-SaBE3 |
| P1151LVS/F | CCA | YYA | AGCCAGAGGCCUGUUUCACA | 642 | (GATGGT) | 20 (C3/4) | KKH-SaBE3 |
| C1154Y | TGT | TAT | AAACAGGCCUCUGGCUCAUC | 643 | (GGAA) | 20 (C6) | VQR-SpBE3 |
| C1154Y | TGT | TAT | GAAACAGGCCUCUGGCUCAU | 644 | (CGG) | 20 (C7) | SpBE3 |
| C1154Y | TGT | TAT | CCAUCUGUGAAACAGGCCUC | 645 | (TGG) | 20 (C15) | SpBE3 |
| C1154Y | TGT | TAT | GAAACAGGCCUCUGGCUCAU | 646 | (CGGAAT) | 20 (C7) | SaBE3 |
| C1159Y | TGT | TAT | CAUACACAACCUGACAAGAA | 647 | (AGAC) | 20 (C7) | VQR-SpBE3 |
| C1159Y | TGT | TAT | CCAUACACAACCUGACAAGA | 648 | (AAG) | 20 (C8) | SpBE3 |
| C1159Y | TGT | TAT | CCUCCAUACACAACCUGACA | 649 | (AGAA) | 20 (C11) | VQR-SpBE3 |
| C1159Y | TGT | TAT | ACCUCCAUACACAACCUGAC | 650 | (AAG) | 20 (C12) | SpBE3 |
| C1159Y | TGT | TAT | AACCUCCAUACACAACCUGA | 651 | (CAAGAAA) | 20 (C13) | St1BE3 |
| P1285LVS/F | CCC | YYC | UUGGCCCCAUUAAAUCCCUU | 652 | (CGG) | 20 (C6/7) | SpBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P1285LVS/F | CCC | YYC | UGGCCCCAUU AAAUCCCUUC | 653 | (GGAC) | 20 (C5/6) | VQR-SpBE3 |
| P1297LVS/F | CCT | YYT | AGACCUCUAA GAGCCUUAUC | 654 | (TAG) | 20 (C4/5) | SpBE3 |
| P1297LVS/F | CCT | YYT | UACCUCUAAG AGCCUUAUCU | 655 | (AGAT) | 20 (C3/4) | VQR-SpBE3 |
| P1297LVS/F | CCT | YYT | AAGACCUCUA AGAGCCUUAU | 656 | (CTAGAT) | 20 (C5/6) | KKH-SaBE3 |
| P1319LVS/F | CCT | YYT | AGGAGCAAUU CCUUCCAUCA | 657 | (TGAA) | 20 (C11/12) | VQR-SpBE3 |
| P1319LVS/F | CCT | YYT | GCAAUUCCUU CCAUCAUGAA | 658 | (TGTG) | 20 (C7/8) | VQR-SpBE3 |
| P1319LVS/F | CCT | YYT | UAGGAGCAAU UCCUUCCAUC | 659 | (ATGAAT) | 20 (C12/13) | SaBE3 |
| C1328Y | TGT | TAT | ACACACAAGU AGCACAUUCA | 660 | (TGAT) | 20 (C4) | VQR-SpBE3 |
| C1328Y | TGT | TAT | AGACACACAA GUAGCACAUU | 661 | (CATGAT) | 20 (C6) | KKH-SaBE3 |
| G1339R | GGA | ARA | CCAUGAUGCU GAAUAUCAGC | 662 | (CAG) | 20 (C-1) | SpBE3 |
| G1339R | GGA | ARA | ACUCCCAUGA UGCUGAAUAU | 663 | (CAG) | 20 (C4) | SpBE3 |
| G1339R | GGA | ARA | CAAAUUUACU CCCAUGAUGC | 664 | (TGAA) | 20 (C11) | VQR-SpBE3 |
| G1339R | GGA | ARA | CCAUGAUGCU GAAUAUCAGC | 665 | (CAGAAT) | 20 (C1) | SaBE3 |
| G1339R | GGA | ARA | ACAAAUUUAC UCCCAUGAUG | 666 | (CTGAAT) | 20 (C12) | SaBE3 |
| G1339R | GGA | ARA | CCCAUGAUGC UGAAUAUCAG | 667 | (CCAGAAT) | 20 (C1) | St1BE3 |
| C1350Y | TGT | TAT | AAUACACUCA UAGAACUUGC | 668 | (CAG) | 20 (C7) | SpBE3 |
| P1360LVS/F | CCT | YYT | GUCACGGUUU CCUGCAAGUC | 669 | (AAG) | 20 (C11/12) | SpBE3 |
| P1360LVS/F | CCT | YYT | GGGUCACGGU UUCCUGCAAG | 670 | (TCAAGT) | 20 (C13/14) | KKH-SaBE3 |
| P1360LVS/F | CCT | YYT | GGUUUCCUGC AAGUCAAGUU | 671 | (CCAAAT) | 20 (C6/7) | KKH-SaBE3 |
| P1365LVS/F | CCA | YYA | AGUCAAGUUC CAAAUCGUUC | 672 | (CGAA) | 20 (C10/11) | VQR-SpBE3 |
| P1365LVS/F | CCA | YYA | AAGUCAAGUU CCAAAUCGUU | 673 | (CCGAAT) | 20 (C11/12) | SaBE3 |
| C1370Y | TGT | TAT | AUUCGGAACG AUUUGGAACU | 674 | (TGAC) | 20 (C2) | VQR-SpBE3 |
| C1370V | TGT | TAT | CAAAACAUUC GGAACGAUUU | 675 | (GGAA) | 20 (C8) | VQR-SpBE3 |
| C1370Y | TGT | TAT | GCAAAACAUU CGGAACGAUU | 676 | (TGG) | 20 (C9) | SpBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| C1370Y | TGT | TAT | UAAGGGCAAA ACAUUCGGAA | 677 | (CGAT) | 20 (C14) | VQR-SpBE3 |
| C1370Y | TGT | TAT | CAUAAGGGCA AAACAUUCGG | 678 | (AACGAT) | 20 (C16) | KKH-SaBE3 |
| P1425L7S/F | CCC | YYC | GUAGACAAGC AGCCCAAAUA | 679 | (TGAA) | 20 (C13/14) | VQR-SpBE3 |
| P1425L7S/F | CCC | YYC | AAGCAGCCCA AUAUGAAUA | 680 | (TAG) | 20 (C7/8) | SpBE3 |
| G1444R | GGG | ARR | UGACCCAAAG AUGAUAAAGA | 681 | (CGAC) | 20 (C5) | VQR-SpBE3 |
| G1444R | GGG | ARR | GAAUGACCCA AAGAUGAUAA | 682 | (AGAC) | 20 (C8) | VQR-SpBE3 |
| G1444R | GGG | ARR | AGAAUGACCC AAAGAUGAUA | 683 | (AAG) | 20 (C9) | SpBE3 |
| G1444R | GGG | ARR | AGUGAAGAAU GACCCAAAGA | 684 | (TGAT) | 20 (C14) | VQR-SpBE3 |
| G1444R | GGG | ARR | CCCAAAGAUG AUAAAGACGA | 685 | (CAAAAT) | 20 (C2) | KKH-SaBE3 |
| S1490F[b] | TCC | TTY | UGGGGUCCAA GAAGCCACAA | 686 | (AAG) | 20 (C7/8) | SpBE3 |
| S1490F[b] | TCC | TTY | GGGUCCAAGA AGCCACAAAA | 687 | (GCCAAT) | 20 (C5/6) | KKH-SaBE3 |
| P1493/6L/S/F | CCA | YYA | AGCCACAAAA GCCAAUUCCU | 688 | (CGAC) | 20 (C3/4/12) | VQR-SpBE3 |
| P1493US/F | CCA | YYA | GGGUCCAAGA AGCCACAAAA | 689 | (GCCAAT) | 20 (C13/14) | KKH-SaBE3 |
| P1496L7S/F | CCA | YYA | ACAAAAGCCA AUUCUUCGAC | 690 | (CAG) | 20 (C8/9) | SpBE3 |
| P1496/8L/S/F | CCA | YYA | CAAAAGCCAA UUCCUCGACC | 691 | (AGG) | 20 (C7-14) | SpBE3 |
| P1496/8L/S/F | CCA | YYA | AAAAGCCAAU UCCUCGACCA | 692 | (GGG) | 20 (C6-13) | SpBE3 |
| P1496/8L/S/F | CCA | YYA | AAAGCCAAUU CCUCGACCAG | 693 | (GGG) | 20 (C5-12) | SpBE3 |
| P1496/8L/S/F | CCA | YYA | AAAGCCAAUU CCUCGACCAG | 694 | (GGG) | 20 (C5-12) | SpBE3 |
| P1496/8USI F | CCA | YYA | CAAAAGCCAA UUCCUCGACC | 695 | (AGGGGT) | 20 (C7-14) | SaBE3 |
| P1496L7S/F | CCA | YYA | CAAAAGCCAA UUCCUCGACC | 696 | (AGGGG) | 20 (C7-14) | St3BE3 |
| P1498/1500 L/S/F | CCT | YYT | AAUUCCUCGA CCAGGGGUAA | 697 | (AAAAAT) | 20 (C5-12) | KKH-SaBE3 |
| P1500L7S/F | CCA | YYA | AAUUCCUCGA CCAGGGGUAA | 698 | (AAAAAT) | 20 (C11/12) | KKH-SaBE3 |
| C1526Y | TGT | TAT | GUUGAGACAG AUAAGAACCA | 699 | (TGAT) | 20 (C8) | VQR-SpBE3 |
| C1526Y | TGT | TAT | UUACCAUGUU GAGACAGAUA | 700 | (AGAA) | 20 (C15) | VQR-SpBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| C1526Y | TGT | TAT | GUUACCAUGUUGAGACAGAU | 701 | (AAG) | 20 (C16) | SpBE3 |
| C1526Y | TGT | TAT | AGACAGAUAAGAACCAUGAU | 702 | (ACTAAT) | 20 (C4) | KKH-SaBE3 |
| C1526Y | TGT | TAT | AUGUUGAGACAGAUAAGAAC | 703 | (CATGAT) | 20 (C10) | KKH-SaBE3 |
| C1526Y | TGT | TAT | GGUUACCAUGUUGAGACAGA | 704 | (TAAGAAC) | 20 (C17) | St1BE3 |
| G1560R | GGA | ARA | CACACAUUCUCCAGUGAAAA | 705 | (GGAT) | 20 (C11) | VQR-SpBE3 |
| G1560R | GGA | ARA | GCACACAUUCUCCAGUGAAA | 706 | (AGG) | 20 (C12) | SpBE3 |
| G1560R | GGA | ARA | AGCACACAUUCUCCAGUGAA | 707 | (AAG) | 20 (C13) | SpBE3 |
| G1560R | GGA | ARA | AGCACACAUUCUCCAGUGAA | 708 | (AAGGAT) | 20 (C13) | SaBE3 |
| C1562Y | TGT | TAT | CACACAUUCUCCAGUGAAAA | 709 | (GGAT) | 20 (C5) | VQR-SpBE3 |
| C1562Y | TGT | TAT | GCACACAUUCUCCAGUGAAA | 710 | (AGG) | 20 (C6) | SpBE3 |
| C1562Y | TGT | TAT | AGCACACAUUCUCCAGUGAA | 711 | (AAG) | 20 (C7) | SpBE3 |
| C1562Y | TGT | TAT | UUUUAGCACACAUUCUCCAG | 712 | (TGAA) | 20 (C11) | VQR-SpBE3 |
| C1562Y | TGT | TAT | AGUUUUAGCACACAUUCUCC | 713 | (AGTG) | 20 (C13) | VQR-SpBE3 |
| C1562Y | TGT | TAT | CAGUUUUAGCACACAUUCUC | 714 | (CAG) | 20 (C14) | SpBE3 |
| C1562Y | TGT | TAT | AGCACACAUUCUCCAGUGAA | 715 | (AAGGAT) | 20 (CT) | SaBE3 |
| C1562Y | TGT | TAT | AUCAGUUUUAGCACACAUUC | 716 | (TCCAGT) | 20 (C16) | KKH-SaBE3 |
| G1577R | GGA | ARA | CCAUCCUACAGUGAAGUAGU | 717 | (AGTG) | 20 (C5) | VQR-SpBE3 |
| G1577R | GGA | ARA | UCCAUCCUACAGUGAAGUAG | 718 | (TAG) | 20 (C6) | SpBE3 |
| G1577R | GGA | ARA | UAUUCCAUCCUACAGUGAAG | 719 | (TAG) | 20 (C9) | SpBE3 |
| G1577R | GGA | ARA | AAAUAUUCCAUCCUACAGUG | 720 | (AAG) | 20 (C12) | SpBE3 |
| G1577R | GGA | ARA | AAAAAUAUUCCAUCCUACAG | 721 | (TGAA) | 20 (C14) | VQR-SpBE3 |
| G1577R | GGA | ARA | AUUCCAUCCUACAGUGAAGU | 722 | (AGTAGT) | 20 (C8) | KKH-SaBE3 |
| G1577R | GGA | ARA | AAUAUUCCAUCCUACAGUGA | 723 | (AGTAGT) | 20 (C11) | KKH-SaBE3 |
| G1577R | GGA | ARA | AAAAAUAUUCCAUCCUACAG | 724 | (TGAAGT) | 20 (C14) | KKH-SaBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P1606L7S/F | CCT | YYT | UUGUGUCCCCUACCCUGUUC | 725 | (CGAG) | 20 (C9/10) | EQR-SpBE3 |
| P1606LVS/F | CCT | YYT | UGUGUCCCCUACCCUGUUCC | 726 | (GAG) | 20 (C8/9) | SpBE3 |
| P1606L7S/F | CCT | YYT | GUGUCCCCUACCCUGUUCCG | 727 | (AGTG) | 20 (C7/8) | VQR-SpBE3 |
| P1606LVS/F | CCT | YYT | GUCCCCUACCCUGUUCCGAG | 728 | (TGAT) | 20 (C5/6) | VQR-SpBE3 |
| P1606LVS/F | CCT | YYT | UUUGUGUCCCCUACCCUGUU | 729 | (CCGAGT) | 20 (C10/11) | SaBE3 |
| P1606LVS/F | CCT | YYT | GUGUCCCCUACCCUGUUCCG | 730 | (AGTGAT) | 20 (C7/8) | KKH-SaBE3 |
| G1626R | GGA | ARA | CUUUGACUAGACGUAGGAUU | 731 | (CGG) | 20 (C-1) | SpBE3 |
| G1626R | GGA | ARA | UGCUCCUUUGACUAGACGUA | 732 | (GGAT) | 20 (C5) | VQR-SpBE3 |
| G1626R | GGA | ARA | UUGCUCCUUUGACUAGACGU | 733 | (AGG) | 20 (C6) | SpBE3 |
| G1626R | GGA | ARA | UUUGCUCCUUUGACUAGACG | 734 | (TAG) | 20 (CT) | SpBE3 |
| G1626R | GGA | ARA | UCCCCUUUGCUCCUUUGACU | 735 | (AGAC) | 20 (C12) | VQR-SpBE3 |
| G1626R | GGA | ARA | AUCCCCUUUGCUCCUUUGAC | 736 | (TAG) | 20 (C13) | SpBE3 |
| G1626R | GGA | ARA | UUUGCUCCUUUGACUAGACG | 737 | (TAGGAT) | 20 (CT) | SaBE3 |
| G1629R | GGG | ARR | UCCCCUUUGCUCCUUUGACU | 738 | (AGAC) | 20 (C3) | VQR-SpBE3 |
| G1629R | GGG | ARR | AUCCCCUUUGCUCCUUUGAC | 739 | (TAG) | 20 (C4) | SpBE3 |
| G1629R | GGG | ARR | GCGGAUCCCCUUUGCUCCUU | 740 | (TGAC) | 20 (C8) | VQR-SpBE3 |
| P1642LVS/F | CCT | YYT | CUUCCUGCGUUGUUUAACAU | 741 | (CGG) | 20 (C4/5) | SpBE3 |
| G1662R | GGA | ARA | CAUUCCAAAGAUGGCGUAGA | 742 | (TGAA) | 20 (C5) | VQR-SpBE3 |
| G1662R | GGA | ARA | GGACAUUCCAAAGAUGGCGU | 743 | (AGAT) | 20 (C8) | VQR-SpBE3 |
| G1662R | GGA | ARA | UGGACAUUCCAAAGAUGGCG | 744 | (TAG) | 20 (C9) | SpBE3 |
| G1662R | GGA | ARA | AAGUUGGACAUUCCAAAGAU | 745 | (GGCG) | 20 (C13) | VRER-SpBE3 |
| G1662R | GGA | ARA | UUGGACAUUCCAAAGAUGGC | 746 | (GTAGAT) | 20 (C10) | KKH-SaBE3 |
| G1662R | GGA | ARA | AAAGUUGGACAUUCCAAAGA | 747 | (TGGCG) | 20 (C14) | St3BE3 |
| C1690Y | TGC | TAC | GCAAAUCAUACUGUUGCCAA | 748 | (AGG) | 20 (C2) | SpBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| C1690Y | TGC | TAC | GGCAAAUCAUACUGUUGCCA | 749 | (AAG) | 20 (C3) | SpBE3 |
| C1690Y | TGC | TAC | AGGCAAAUCAUACUGUUGCC | 750 | (AAAGGT) | 20 (C4) | KKH-SaBE3 |
| P1706LVS/F | CCT | YYT | UUGCUAGCACCUAUUCUUAA | 751 | (CAG) | 20 (C10/11) | SpBE3 |
| P1706LVS/F | CCT | YYT | UAGCACCUAUUCUUAACAGU | 752 | (AAG) | 20 (C6/7) | SpBE3 |
| P1706L7S/F | CCT | YYT | GAUUGCUAGCACCUAUUCUU | 753 | (AACAGT) | 20 (C12/13) | KKH-SaBE3 |
| P1712LVS/F | CCA | YYA | UUAACAGUAAGCCACCCGAC | 754 | (TGTG) | 20 (C12-14) | VQR-SpBE3 |
| P1712L7S/F | CCA | YYA | AACAGUAAGCCACCCGACUG | 755 | (TGAC) | 20 (C10/11) | VQR-SpBE3 |
| P1712/3L/S/F | CCA | YYA | CCACCCGACUGUGACCCAAA | 756 | (AAAAGT) | 20 (C1-5) | KKH-SaBE3 |
| P1713L/S/F | CCC | YYC | ACCCGACUGUGACCCAAAAA | 757 | (AAG) | 20 (C2/3) | SpBE3 |
| C1715Y | TGT | TAT | AGUCGGGUGGCUUACUGUUA | 758 | (AGAA) | 20 (C-1) | VQR-SpBE3 |
| C1715Y | TGT | TAT | CAGUCGGGUGGCUUACUGUU | 759 | (AAG) | 20 (C1) | SpBE3 |
| C1715Y | TGT | TAT | UUUUUUGGGUCACAGUCGGG | 760 | (TGG) | 20 (C13) | SpBE3 |
| C1715Y | TGT | TAT | CUUUUUUUGGGUCACAGUCG | 761 | (GGTG) | 20 (C15) | VQR-SpBE3 |
| C1715Y | TGT | TAT | ACUUUUUUUGGGUCACAGUC | 762 | (GGG) | 20 (C16) | SpBE3 |
| C1715Y | TGT | TAT | CAGUCGGGUGGCUUACUGUU | 763 | (AAGAAT) | 20 (C1) | SaBE3 |
| C1715Y | TGT | TAT | GAACUUUUUUUGGGUCACAG | 764 | (TCGGGT) | 20 (C18) | SaBE3 |
| C1715Y | TGT | TAT | ACAGUCGGGUGGCUUACUGU | 765 | (TAAGAAT) | 20 (C2) | St1BE3 |
| C1715Y | TGT | TAT | ACUUUUUUUGGGUCACAGUC | 766 | (GGGTG) | 20 (C16) | St3BE3 |
| P1717L/S/F | CCA | YYA | GACCCAAAAAAAGUUCAUCC | 767 | (TGG) | 20 (C4/5) | SpBE3 |
| P1717US/F | CCA | YYA | ACCCAAAAAAAGUUCAUCCU | 768 | (GGAA) | 20 (C3/4) | VQR-SpBE3 |
| P1717L7S/F | CCA | YYA | CCAAAAAAAGUUCAUCCUGG | 769 | (AAG) | 20 (C1/2) | SpBE3 |
| P1717L/S/F | CCA | YYA | ACCCAAAAAAAGUUCAUCCU | 770 | (GGAAGT) | 20 (C3/4) | KKH-SaBE3 |
| P1722L/S/F | CCT | YYT | AAAAGUUCAUCCUGGAAGUU | 771 | (CAG) | 20 (C11/12) | SpBE3 |
| P1722L/S/F | CCT | YYT | GUUCAUCCUGGAAGUUCAGU | 772 | (TGAA) | 20 (C7/8) | VQR-SpBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P1722L/S/F | CCT | YYT | UCAUCCUGGA AGUUCAGUUG | 773 | (AAG) | 20 (C5/6) | SpBE3 |
| P1722L/S/F | CCT | YYT | CAUCCUGGAA GUUCAGUUGA | 774 | (AGG) | 20 (C4/5) | SpBE3 |
| P1722L/S/F | CCT | YYT | AUCCUGGAAG UUCAGUUGAA | 775 | (GGAG) | 20 (C3/4) | EQR-SpBE3 |
| P1722L/S/F | CCT | YYT | UCCUGGAAGU UCAGUUGAAG | 776 | (GAG) | 20 (C2/3) | SpBE3 |
| P1722L/S/F | CCT | YYT | CCUGCAAGUU CACUUCAAGC | 777 | (ACAC) | 20 (C1/2) | VQR-SpBE3 |
| P1722L/S/F | CCT | YYT | AAAAAAGUUC AUCCUGGAAG | 778 | (TTCAGT) | 20 (C13/14) | KKH-SaBE3 |
| P1722L/S/F | CCT | YYT | CAUCCUGGAA GUUCAGUUGA | 779 | (AGGAG) | 20 (C4/5) | St3BE3 |
| C1730Y | TGT | TAT | UUACCACAGU CUCCUUCAAC | 780 | (TGAA) | 20 (C7) | VQR-SpBE3 |
| P1733L/S/F | CCA | YYA | GACUGUGGUA ACCCAUCUGU | 781 | (TGG) | 20 (C13/14) | SpBE3 |
| P1733L/S/F | CCA | YYA | ACUGUGGUAA CCCAUCUGUU | 782 | (GGAA) | 20 (C12/13) | VQR-SpBE3 |
| P1733L/S/F | CCA | YYA | GACUGUGGUA ACCCAUCUGU | 783 | (TGGAAT) | 20 (C13/14) | SaBE3 |
| G1736R | GGA | ARA | UUCCAACAGA UGGGUUACCA | 784 | (CAG) | 20 (C3) | SpBE3 |
| G1736R | GGA | ARA | AGUAGAAUAU UCCAACAGAU | 785 | (GGG) | 20 (C12) | SpBE3 |
| G1736R | GGA | ARA | AAGUAGAAUA UUCCAACAGA | 786 | (TGG) | 20 (C13) | SpBE3 |
| G1736R | GGA | ARA | UAUUCCAACA GAUGGGUUAC | 787 | (CACAGT) | 20 (C5) | KKH-SaBE3 |
| G1736R | GGA | ARA | AAAGUAGAAU AUUCCAACAG | 788 | (ATGGGT) | 20 (C14) | SaBE3 |
| P1773I/S/F | CCT | YYT | GAAAGUACUG AACCUCUGAG | 789 | (TGAG) | 20 (C13/14) | EQR-SpBE3 |
| P1773L/S/F | CCT | YYT | AAAGUACUGA ACCUCUGAGU | 790 | (GAG) | 20 (C12/13) | SpBE3 |
| P1773L/S/F | CCT | YYT | AAGUACUGAA CCUCUGAGUG | 791 | (AGG) | 20 (C11/12) | SpBE3 |
| P1773L/S/F | CCT | YYT | AGUACUGAAC CUCUGAGUGA | 792 | (GGAT) | 20 (C10/11) | VQR-SpBE3 |
| P1773L/S/F | CCT | YYT | ACUGAACCUC UGAGUGAGGA | 793 | (TGAC) | 20 (C7/8) | VQR-SpBE3 |
| P1773L/S/F | CCT | YYT | CCUCUGAGUG AGGAUGACUU | 794 | (TGAG) | 20 (C1/2) | EQR-SpBE3 |
| P1773L/S/F | CCT | YYT | AAAGUACUGA ACCUCUGAGU | 795 | (GAGGAT) | 20 (C12/13) | SaBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P1773LVS/F | CCT | YYT | CCUCUGAGUGAGGAUGACUU | 796 | (TGAGAT) | 20 (C1/2) | KKH-SaBE3 |
| P1791LVS/F | CCC | YYC | AGUUUGAUCCCGAUGCGACC | 797 | (CAG) | 20 (C9/10) | SpBE3 |
| P1791LVS/F | CCC | YYC | UCCCGAUGCGACCCAGUUUA | 798 | (TAG) | 20 (C2/3) | SpBE3 |
| P1791LVS/F | CCC | YYC | CCCGAUGCGACCCAGUUUAU | 799 | (AGAG) | 20 (C1/2) | EQR-SpBE3 |
| P1791LVS/F | CCC | YYC | GAAGUUUGAUCCCGAUGCGA | 800 | (CCCAGT) | 20 (C11/12) | KKH-SaBE3 |
| P1791LVS/F | CCC | YYC | UCCCGAUGCGACCCAGUUUA | 801 | (TAGAGT) | 20 (C2/3) | SaBE3 |
| P1811/2LVS/F | CCT | YYT | CCUGGAUCCUCCUCUUCUCA | 802 | (TAG) | 20 (C8-12) | SpBE3 |
| P1818LVS/F | CCC | YYC | UCUCAUAGCAAAACCCAACA | 803 | (AAG) | 20 (C14/15) | SpBE3 |
| P1818LVS/F | CCC | YYC | UAGCAAAACCCAACAAAGUC | 804 | (CAG) | 20 (C9/10) | SpBE3 |
| P1818LVS/F | CCC | YYC | CUUCUCAUAGCAAAACCCAA | 805 | (CAAAGT) | 20 (C16/17) | KKH-SaBE3 |
| P1829LVS/F | CCC | YYC | GCCAUGGAUCUGCCCAUGGU | 806 | (TAG) | 20 (C13/14) | SpBE3 |
| P1829LVS/F | CCC | YYC | CCAUGGAUCUGCCCAUGGUU | 807 | (AGTG) | 20 (C12/13) | VQR-SpBE3 |
| P1829LVS/F | CCC | YYC | AUGGAUCUGCCCAUGGUUAG | 808 | (TGG) | 20 (C10/11) | SpBE3 |
| P1829IVS/F | CCC | YYC | UGGAUCUGCCCAUGGUUAGU | 809 | (GGTG) | 20 (C9/10) | VQR-SpBE3 |
| P1829LVS/F | CCC | YYC | GAUCUGCCCAUGGUUAGUGG | 810 | (TGAC) | 20 (C7/8) | VQR-SpBE3 |
| P1829LVS/F | CCC | YYC | UGCCCAUGGUUAGUGGUGAC | 811 | (CGG) | 20 (C3/4) | SpBE3 |
| P1829LVS/F | CCC | YYC | GCCCAUGGUUAGUGGUGACC | 812 | (GGAT) | 20 (C2/3) | VQR-SpBE3 |
| P1829LVS/F | CCC | YYC | UUGCCAUGGAUCUGCCCAUG | 813 | (GTTAGT) | 20 (C15/16) | KKH-SaBE3 |
| P1829LVS/F | CCC | YYC | CCAUGGAUCUGCCCAUGGUU | 814 | (AGTGGT) | 20 (C12/13) | KKH-SaBE3 |
| P1829LVS/F | CCC | YYC | CUGCCCAUGGUUAGUGGUGA | 815 | (CCGGAT) | 20 (C4/5) | SaBE3 |
| P1829LVS/F | CCC | YYC | AUGGAUCUGCCCAUGGUUAG | 816 | (TGGTG) | 20 (C10/11) | St3BE3 |
| P1872LVS/F | CCT | YYT | AUGUCUGCAAAUCCUUCCAA | 817 | (AGTG) | 20 (C13/14) | VQR-SpBE3 |
| P1872LVS/F | CCT | YYT | AAUCCUUCCAAAGUGUCCUA | 818 | (TGAA) | 20 (C4/5) | VQR-SpBE3 |
| P1872LVS/F | CCT | YYT | UUCAUGUCUGCAAAUCCUUC | 819 | (CAAAGT) | 20 (C16/17) | KKH-SaBE3 |

TABLE 2-continued

Exemplary NaV1.7 (SNA9A) Protective Loss-of-Function Mutations via Codon Changes

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| P1943LVS/F | CCA | YYA | GAACUCAAGU CCAGAAAAAA | 820 | (CAG) | 20 (C11/12) | SpBE3 |
| P1943LVS/F | CCA | YYA | AACUCAAGUC CAGAAAAAAC | 821 | (AGAT) | 20 (C10/11) | VQR-SpBE3 |
| P1943LVS/F | CCA | YYA | AGAACUCAAG UCCAGAAAAA | 822 | (ACAGAT) | 20 (C12/13) | KKH-SaBE3 |
| P1955LVS/F | CCA | YYA | CCACCACCUC UCCACCUUCA | 823 | (TATGAT) | 20 (C12/13) | KKH-SaBE3 |
| P1955/6L/S/F | CCA | YYA | ACCACCUCUC CACCUUCAUA | 824 | (TGAT) | 20 (C10-14) | VQR-SpBE3 |
| P1955/6LVS/F | CCA | YYA | ACCUCUCCAC CUUCAUAUGA | 825 | (TAG) | 20 (C7-11) | SpBE3 |
| P1955/6LVS/F | CCA | YYA | CCUCUCCACC UUCAUAUGAU | 826 | (AGTG) | 20 (C6-10) | VQR-SpBE3 |
| P1955/6L/S/F | CCA | YYA | CCACCUCUCC ACCUUCAUAU | 827 | (GATAGT) | 20 (C9-13) | KKH-SaBE3 |
| P1964LVS/F | CCA | YYA | AGUGUAACAA AGCCAGACAA | 828 | (AGAG) | 20 (C13/14) | EQR-SpBE3 |
| P1964LVS/F | CCA | YYA | GUGUAACAAA GCCAGACAAA | 829 | (GAG) | 20 (C12/13) | SpBE3 |
| P1964LVS/F | CCA | YYA | UGUAACAAAG CCAGACAAAG | 830 | (AGAA) | 20 (C11/12) | VQR-SpBE3 |
| P1964LVS/F | CCA | YYA | AAGCCAGACA AAGAGAAAUA | 831 | (TGAA) | 20 (C4/5) | VQR-SpBE3 |
| P1964LVS/F | CCA | YYA | UGUAACAAAG CCAGACAAAG | 832 | (AGAAAT) | 20 (C11/12) | KKH-SaBE3 |
| P1964LVS/F | CCA | YYA | AGUGUAACAA AGCCAGACAA | 833 | (AGAGAAA) | 20 (C13/14) | St1BE3 |

[a]BE types: SpBE3 = APOBEC1-SpCas9n-UGI; VQR-SpBE3 = APOBEC1-VQR-SpCas9n-UGI: EQR-SpBE3 = APOBEC1-EQR-SpCas9n-UGI; VRER-SpBE3 = APOBEC1-VRER-SpCas9n-UGI; SaBE3 = APOBEC1-SaCas9n-UGI; KKH-SaBE3 = APOBEC1-KKH-SaCas9n-UGI; St3BE3 = APOBEC1-St3Cas9n-UGI; St1BE3 = APOBEC1-St1Cas9n-UGI.
[b]Phospho-serine site S1490.

In some embodiments, editing of an ion channel-encoding nucleotide results in a destabilized or misfolded ion channel protein. An ion channel mutant comprising one or more destabilizing mutations described herein may have reduced activity compared to the wild type ion channel protein. For example, the activity of an ion channel variant comprising one or more destabilizing mutations described herein may be reduced by at least about 20%, at least about 30%, at least about 40%, at least about 50%, at least about 60%, at least about 70%, at least about 80%, at least about 90%, at least about 95%, at least about 99%, or more.

Premature Stop Codons

Some aspects of the present disclosure provide strategies of editing an ion channel gene (e.g., SCN9A gene) to reduce the amount of full-length, functional ion channel protein (e.g., NaV1.7 protein) being produced. In some embodiments, stop codons may be introduced into the coding sequence of an ion channel gene upstream of the normal stop codon (referred to as a "premature stop codon"). Premature stop codons cause premature translation termination, in turn resulting in truncated and nonfunctional proteins and induces rapid degradation of the mRNA via the non-sense mediated mRNA decay pathway. See, e.g., Baker et al., *Current Opinion in Cell Biology* 16 (3): 293-299, 2004; Chang et al., Annual Review of Biochemistry 76: 51-74, 2007; and Behm-Ansmant et al., Genes & *Development* 20 (4): 391-398, 2006, each of which is incorporated herein by reference.

The nucleobase editors may be used to convert several amino acid codons to a stop codon (e.g., TAA, TAG, or TGA). For example, nucleobase editors including a cytosine deaminase domain are capable of converting a cytosine (C) base to a thymine (T) base via deamination. Thus, it is envisioned that, for amino acid codons containing a C base, the C base may be converted to T. For example, a CAG (Gln/Q) codon may be changed to a TAG (amber) codon via the deamination of the first C on the coding strand. For sense codons that contain a guanine (G) base, a C base is present on the complementary strand; and the G base may be converted to an adenosine (A) via the deamination of the C on the complementary strand. For example, a T$\underline{\underline{G}}$G (Trp/W) codon may be converted to a T$\underline{\underline{A}}$G (amber) codon via the deamination of the second C on the complementary strand. In some embodiments, two C to T changes are required to convert a codon to a nonsense codon. For example, a $\underline{C}$G$\underline{\underline{G}}$ (R) codon is converted to a $\underline{T}$A$\underline{\underline{G}}$ (amber) codon via the deamination of the first C on the coding strand and the deamination of the second C on the complementary strand. Non-limiting examples of codons that may be changed to stop codons via base editing are provided in Table 3.

TABLE 3

Conversion to Stop Codon

| Target codon | Base-editing process | Edited codon |
| --- | --- | --- |
| CAG (Gln/Q) | 1$^{st}$ base C to T on coding strand | TAG (amber) |
| T$\underline{\underline{G}}$G (Trp/W) | 2$^{nd}$ base C to T on complementary strand | T$\underline{\underline{A}}$G (amber) |
| $\underline{C}$GA (Arg/R) | 1$^{st}$ base C to T on coding strand | TGA (opal) |
| $\underline{C}$AA (Gln/Q) | 1$^{st}$ base C to T on coding strand | TAA (ochre) |
| T$\underline{\underline{G}}$G (Trp/W) | 3$^{rd}$ base C to T on complementary strand | T$\underline{\underline{G}}$A (opal) |
| C$\underline{G}$$\underline{\underline{G}}$ (Arg/R) | 1$^{st}$ base C to T on coding strand and 2$^{nd}$ base C to T on complementary strand | TA$\underline{\underline{G}}$ (amber) |
| C$\underline{G}$A (Arg/R) | 1$^{st}$ base C to T on coding strand and 2$^{nd}$ base C to T on complementary strand | T$\underline{\underline{A}}$A (orchre) |

\* single underline: changes on the coding strand
double underline: changes on the complementary strand Non-limiting examples of codons in the SCN9A gene that may be changed to stop codons by the nucleobase editor are provided in Table 4. In some embodiments, the introduction of stop codons may be efficacious in generating truncations when the target residue is located in a flexible loop. In some embodiments, two codons adjacent to each other may both be converted to stop codons, resulting in two stop codons adjacent to each other (also referred to as "tandem stop codons"). "Adjacent" means there are no more than 5 amino acids between the two stop codons. For example, the two stop codons may be immediately adjacent to each other (0 amino acids in between) or have 1, 2, 3, 4, or 5 amino acids in between. Non-limiting examples of tandem stop codons that may be introduced are listed in Table 4 (e.g., Q368X/Q369X, Q408X/Q410X, Q1539X/Q1541X, wherein X is a stop codon). In some embodiments, a stop codon is introduced adjacent to a structurally destabilizing mutation.

TABLE 4

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs | (PAM) | gRNA size (C edited) | BE type$^a$ |
| --- | --- | --- | --- | --- | --- | --- | --- |
| Q18X | CAG | TAG | AAACAGUCUCUUGCCCUCAU | 834 | (TGAA) | 20 (C4) | VQR-SpBE3 |
| Q25X | CAA | TAA | CUCAUUGAACAACGCAUUGC | 835 | (TGAA) | 20 (C10) | VQR-SpBE3 |
| Q25X | CAA | TAA | AUUGAACAACGCAUUGCUGA | 836 | (AAG) | 20 (C7) | SpBE3 |
| Q25X | CAA | TAA | UUGAACAACGCAUUGCUGAA | 837 | (AGAA) | 20 (C6) | VQR-SpBE3 |
| Q25X | CAA | TAA | UGAACAACGCAUUGCUGAAA | 838 | (GAAAAT) | 20 (C5) | KKH-SaBE3 |
| Q25X | CAA | TAA | CAUUGAACAACGCAUUGCUG | 839 | (AAAGAAA) | 20 (C8) | St1BE3 |
| Q58X | CAG | TAG | AAACAGCUGCCCUUCAUCUA | 840 | (TGG) | 20 (C4) | SpBE3 |
| Q58X | CAG | TAG | AACAGCUGCCCUUCAUCUAU | 841 | (GGG) | 20 (C3) | SpBE3 |
| Q58X | CAG | TAG | ACAGCUGCCCUUCAUCUAUG | 842 | (GGG) | 20 (C2) | SpBE3 |

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| Q58X | CAG | TAG | CAGCUGCCCUUCAUCUAUGG | 843 | (GGAC) | 20(C1) | VQR-SpBE3 |
| Q58X | CAG | TAG | AAACAGCUGCCCUUCAUCUA | 844 | (TGGGG) | 20 (C4) | St3BE3 |
| W151X | TGG | TAR | CCAGUCCGGUGGGUUAUUCA | 845 | (TGG) | 20(C2) | SpBE3 |
| W151X | TGG | TAR | CAUUUUUGGUCCAGUCCGGU | 846 | (GGG) | 20 (C12) | SpBE3 |
| W151X | TGG | TAR | ACAUUUUUGGUCCAGUCCGG | 847 | (TGG) | 20 (C13) | SpBE3 |
| W151X | TGG | TAR | GUCCAGUCCGGUGGGUUAUU | 848 | (CATGGT) | 20(C4) | KKH-SaBE3 |
| W151X | TGG | TAR | GACAUUUUUGGUCCAGUCCG | 849 | (GTGGGT) | 20 (C14) | SaBE3 |
| W188X | TGG | TAR | CCACGGGUCACGAAGAAAAG | 850 | (TGAA) | 20 (C2) | VQR-SpBE3 |
| W188X | TGG | TAR | UUCCACGGGUCACGAAGAAA | 851 | (AGTG) | 20(C4) | VQR-SpBE3 |
| W188X | TGG | TAR | GUUCCACGGGUCACGAAGAA | 852 | (AAG) | 20 (C5) | SpBE3 |
| W188X | TGG | TAR | GCCAGUUCCACGGGUCACGA | 853 | (AGAA) | 20 (C9/3) | VQR-SpBE3 |
| W188X | TGG | TAR | AGCCAGUUCCACGGGUCACG | 854 | (AAG) | 20 (C10/4) | SpBE3 |
| W188X | TGG | TAR | CCAGCCAGUUCCACGGGUCA | 855 | (CGAA) | 20 (C12/6) | VQR-SpBE3 |
| W188X | TGG | TAR | UCCACGGGUCACGAAGAAAA | 856 | (GTGAAT) | 20 (C3) | SaBE3 |
| W188X | TGG | TAR | CAGUUCCACGGGUCACGAAG | 857 | (AAAAGT) | 20 (C7/1) | KKH-SaBE3 |
| W188X | TGG | TAR | CAGCCAGUUCCACGGGUCAC | 858 | (GAAGAAA) | 20 (C11/5) | St1BE3 |
| W190X | TGG | TAR | CAAAAUCCAGCCAGUUCCAC | 859 | (GGG) | 20 (C12) | SpBE3 |
| W190X | TGG | TAR | ACAAAAUCCAGCCAGUUCCA | 860 | (CGG) | 20 (C13) | SpBE3 |
| W190X | TGG | TAR | GACAAAAUCCAGCCAGUUCC | 861 | (ACGGGT) | 20 (C14) | SaBE3 |
| R214X | CGA | TGA | GUUUCAGCUCUUCGAACUUU | 862 | (CAG) | 20 (C13) | SpBE3 |
| R214X | CGA | TGA | UUUCAGCUCUUCGAACUUUC | 863 | (AGAG) | 20 (C12) | EQR-SpBE3 |
| R214X | CGA | TGA | UUCAGCUCUUCGAACUUUCA | 864 | (GAG) | 20 (C11) | SpBE3 |
| R214X | CGA | TGA | UCUUCGAACUUUCAGAGUAU | 865 | (TGAG) | 20(C5) | EQR-SpBE3 |
| R214X | CGA | TGA | CUUCGAACUUUCAGAGUAUU | 866 | (GAG) | 20 (C4) | SpBE3 |
| R214X | CGA | TGA | UUCGAACUUUCAGAGUAUUG | 867 | (AGAG) | 20 (C3) | EQR-SpBE3 |
| R214X | CGA | TGA | UCGAACUUUCAGAGUAUUGA | 868 | (GAG) | 20 (C2) | SpBE3 |

TABLE 4-continued

Exemplary NaV1.7 (SNA9A) Protective Loss-of-Function Mutations via Premature Stop Codons

| Residue Change | Codon Change | Resulting Codon(

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| W349X | TGG | TAR | GCUAAGAAGGCCCAGCUGAA | 895 | (AGTG) | 20 (C13) | VQR-SpBE3 |
| W349X | TGG | TAR | AAGGCUAAGAAGGCCCAGCU | 896 | (GAAAGT) | 20 (C16) | KKH-SaBE3 |
| Q360X | CAA | TAA | GGCUAAUGACCCAAGAUUAC | 897 | (TGG) | 20 (C12) | SpBE3 |
| Q360X | CAA | TAA | GCUAAUGACCCAAGAUUACU | 898 | (GGG) | 20 (C11) | SpBE3 |
| Q360X | CAA | TAA | CUAAUGACCCAAGAUUACUG | 899 | (GGAA) | 20 (C10) | VQR-SpBE3 |
| W363X | TGG | TAR | UCCCAGUAAUCUUGGGUCAU | 900 | (TAG) | 20 (C4) | SpBE3 |
| W363X | TGG | TAR | AAGGUUUCCCAGUAAUCUU | 901 | (GGG) | 20 (C11) | SpBE3 |
| W363X | TGG | TAR | AAAGGUUUCCCAGUAAUCU | 902 | (TGG) | 20 (C12) | SpBE3 |
| W363X | TGG | TAR | UAAAGGUUUCCCAGUAAUC | 903 | (TTGGGT) | 20 (C13) | SaBE3 |
| Q368/9X | CAA | TAA | UUUACCAACAGGUGAGUACC | 904 | (AAG) | 20 (C6) | SpBE3 |
| Q368/9X | CAA | TAA | UUACCAACAGGUGAGUACCA | 905 | (AGAG) | 20 (C5) | EQR-SpBE3 |
| Q368/9X | CAA | TAA | UACCAACAGGUGAGUACCAA | 906 | (GAG) | 20 (C4) | SpBE3 |
| Q368/9X | CAA | TAA | ACCAACAGGUGAGUACCAAG | 907 | (AGAA) | 20 (C3) | VQR-SpBE3 |
| Q368/9X | CAA | TAA | UUACCAACAGGUGAGUACCA | 908 | (AGAGAAA) | 20 (C5) | St1BE3 |
| Q369X | CAG | TAG | UUUACCAACAGGUGAGUACC | 909 | (AAG) | 20 (C9) | SpBE3 |
| Q369X | CAG | TAG | UUACCAACAGGUGAGUACCA | 910 | (AGAG) | 20 (C8) | EQR-SpBE3 |
| Q369X | CAG | TAG | UACCAACAGGUGAGUACCAA | 911 | (GAG) | 20 (C7) | SpBE3 |
| Q369X | CAG | TAG | ACCAACAGGUGAGUACCAAG | 912 | (AGAA) | 20 (C6) | VQR-SpBE3 |
| Q369X | CAG | TAG | UUACCAACAGGUGAGUACCA | 913 | (AGAGAAA) | 20 (C8) | St1BE3 |
| Q408/10X | CAG | TAG | GAACAGAACCAGGCAAACAU | 914 | (TGAA) | 20 (C4/10) | VQR-SpBE3 |
| Q408/10X | CAG | TAG | ACAGAACCAGGCAAACAUUG | 915 | (AAG) | 20 (C2/8) | SpBE3 |
| Q408/10X | CAG | TAG | CAGAACCAGGCAAACAUUGA | 916 | (AGAA) | 20 (C1/7) | VQR-SpBE3 |
| Q408/10X | CAG | TAG | AACAGAACCAGGCAAACAUU | 917 | (GAAGAAG) | 20 (C3/9) | St1BE3 |
| Q410X | CAG | TAG | GAACCAGGCAAACAUUGAAG | 918 | (AAG) | 20 (C5) | SpBE3 |
| Q418X | CAG | TAG | AGAAGCUAAACAGAAAGAAU | 919 | (TAG) | 20 (C11) | SpBE3 |
| Q418X | CAG | TAG | GAAGCUAAACAGAAAGAAUU | 920 | (AGAA) | 20 (C10) | VQR-SpBE3 |
| Q418X | CAG | TAG | AGAAAGAAUUAGAAUUUCAA | 921 | (CAG) | 20 (C-1) | SpBE3 |

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs | (PAM) | gRNA size (C edited) | BE type[a] |
|---|---|---|---|---|---|---|---|
| R548X | CGA | TGA | UUUUCUGCAAGGCGAAGCAG | 949 | (CAG) | 20 (C13) | SpBE3 |
| R548X | CGA | TGA | UUUCUGCAAGGCGAAGCAGC | 950 | (AGAA) | 20 (C12) | VQR-SpBE3 |
| R548X | CGA | TGA | GCAAGGCGAAGCAGCAGAAC | 951 | (AAG) | 20 (C7) | SpBE3 |
| R548X | CGA | TGA | CUGCAAGGCGAAGCAGCAGA | 952 | (ACAAGT) | 20 (C9) | KKH-SaBE3 |
| R548X | CGA | TGA | GAAGCAGCAGAACAAGUCUU | 953 | (TTTAGT) | 20 (C-1) | KKH-SaBE3 |
| Q595X | CAG | TAG | GUUUGUGCCCCACAGACCCC | 954 | (AGG) | 20 (C13) | SpBE3 |
| Q595X | CAG | TAG | UUUGUGCCCCACAGACCCCA | 955 | (GGAG) | 20 (C12) | EQR-SpBE3 |
| Q595X | CAG | TAG | UUGUGCCCCACAGACCCCAG | 956 | (GAG) | 20 (C11) | SpBE3 |
| Q595X | CAG | TAG | UGUGCCCCACAGACCCCAGG | 957 | (AGCG) | 20 (C10) | VRER-SpBE3 |
| Q595X | CAG | TAG | UGCCCCACAGACCCCAGGAG | 958 | (CGAC) | 20 (C8) | VQR-SpBE3 |
| Q595X | CAG | TAG | CACAGACCCCAGGAGCGACG | 959 | (CAG) | 20 (C3) | SpBE3 |
| Q595X | CAG | TAG | AGACCCCAGGAGCGACGCAG | 960 | (CAG) | 20 (C-1) | SpBE3 |
| Q595X | CAG | TAG | ACAGACCCCAGGAGCGACGC | 961 | (AGCAGT) | 20 (C2) | KKH-SaBE3 |
| Q595X | CAG | TAG | GUUUGUGCCCCACAGACCCC | 962 | (AGGAG) | 20 (C13) | St3BE3 |
| R597X | CGA | TGA | AGACCCCAGGAGCGACGCAG | 963 | (CAG) | 20 (C13) | SpBE3 |
| R597X | CGA | TGA | GAGCGACGCAGCAGUAACAU | 964 | (CAG) | 20 (C4) | SpBE3 |
| Q604X | CAA | TAA | AGUAACAUCAGCCAAGCCAG | 965 | (TAG) | 20 (C13) | SpBE3 |
| Q604X | CAA | TAA | GUAACAUCAGCCAAGCCAGU | 966 | (AGG) | 20 (C12) | SpBE3 |
| Q604X | CAA | TAA | CAGUAACAUCAGCCAAGCCA | 967 | (GTAGGT) | 20 (C14) | KKH-SaBE3 |
| Q604X | CAA | TAA | AGCCAAGCCAGUAGGUCCCC | 968 | (ACCAAT) | 20 (C4) | KKH-SaBE3 |
| Q643X | CAG | TAG | CCCCAAUGGACAGCUUCUGC | 969 | (CAG) | 20 (C11) | SpBE3 |
| Q643X | CAG | TAG | CCCAAUGGACAGCUUCUGCC | 970 | (AGAG) | 20 (C10) | EQR-SpBE3 |
| Q643X | CAG | TAG | CCAAUGGACAGCUUCUGCCA | 971 | (GAG) | 20 (C9) | SpBE3 |
| Q643X | CAG | TAG | CAAUGGACAGCUUCUGCCAG | 972 | (AGG) | 20 (C8) | SpBE3 |
| Q643X | CAG | TAG | AAUGGACAGCUUCUGCCAGA | 973 | (GGTG) | 20 (C7) | VQR-SpBE3 |
| Q643X | CAG | TAG | UGGACAGCUUCUGCCAGAGG | 974 | (TGAT) | 20 (C5) | VQR-SpBE3 |

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs (PAM) | gRNA size (C edited) | BE type[a] |
|---|---|---|---|---|---|---|
| Q643X | CAG | TAG | CCCAAUGGACAGCUUCUGCC | 975 (AGAGGT) | 20 (C10) | KKH-SaBE3 |
| Q643X | CAG | TAG | AAUGGACAGCUUCUGCCAGA | 976 (GGTGAT) | 20 (C7) | KKH-SaBE3 |
| Q643X | CAG | TAG | GGACAGCUUCUGCCAGAGGU | 977 (GATAAT) | 20 (C4) | KKH-SaBE3 |
| Q643X | CAG | TAG | AGCUUCUGCCAGAGGUGAUA | 978 (ATAGAT) | 20 (C-1) | KKH-SaBE3 |
| Q643X | CAG | TAG | CAAUGGACAGCUUCUGCCAG | 979 (AGGTG) | 20 (C8) | St3BE3 |
| Q663X | CAA | TAA | GCACGACCAAUCAAAUACAC | 980 (AAG) | 20 (C8) | SpBE3 |
| Q663X | CAA | TAA | CACGACCAAUCAAAUACACA | 981 (AGAA) | 20 (C7) | VQR-SpBE3 |
| Q663X | CAA | TAA | ACCAAUCAAAUACACAAGAA | 982 (AAG) | 20 (C3) | SpBE3 |
| Q663X | CAA | TAA | CCAAUCAAAUACACAAGAAA | 983 (AGG) | 20 (C2) | SpBE3 |
| Q663X | CAA | TAA | CAAUCAAAUACACAAGAAAA | 984 (GGCG) | 20 (C1) | VRER-SpBE3 |
| Q663X | CAA | TAA | GGCACGACCAAUCAAAUACA | 985 (CAAGAAA) | 20 (C9) | St1BE3 |
| Q663X | CAA | TAA | CCAAUCAAAUACACAAGAAA | 986 (AGGCG) | 20 (C2) | St3BE3 |
| Q687X | CAG | TAG | CAACCUCAGACAGAGAGCAA | 987 (TGAG) | 20 (C7) | EQR-SpBE3 |
| Q687X | CAG | TAG | AACCUCAGACAGAGAGCAAU | 988 (GAG) | 20 (C6) | SpBE3 |
| Q687X | CAG | TAG | CUCAGACAGAGAGCAAUGAG | 989 (TAG) | 20 (C3) | SpBE3 |
| Q687X | CAG | TAG | UCAGACAGAGAGCAAUGAGU | 990 (AGAG) | 20 (C5) | EQR-SpBE3 |
| Q687X | CAG | TAG | CAGACAGAGAGCAAUGAGUA | 991 (GAG) | 20 (C1) | SpBE3 |
| Q687X | CAG | TAG | GAUCCCAACCUCAGACAGAG | 992 (AGCAAT) | 20 (C12) | KKH-SaBE3 |
| Q687X | CAG | TAG | CCAACCUCAGACAGAGAGCA | 993 (ATGAGT) | 20 (C8) | SaBE3 |
| Q708X | CAA | TAA | CCAGACAAAAAUGUCCACCU | 994 (TGG) | 20 (C6) | SpBE3 |
| Q708X | CAA | TAA | CAGACAAAAAUGUCCACCUU | 995 (GGTG) | 20 (C5) | VQR-SpBE3 |
| Q708X | CAA | TAA | GACAAAAAUGUCCACCUUGG | 996 (TGG) | 20 (C3) | SpBE3 |
| Q708X | CAA | TAA | GUCCAGACAAAAAUGUCCAC | 997 (CTTGGT) | 20 (C8) | KKH-SaBE3 |
| Q708X | CAA | TAA | CAGACAAAAAUGUCCACCUU | 998 (GGTGGT) | 20 (C5) | KKH-SaBE3 |
| Q708X | CAA | TAA | CCAGACAAAAAUGUCCACCU | 999 (TGGTG) | 20 (C6) | St3BE3 |
| W713X | TGG | TAR | CAAGGUGGACAUUUUUGUCU | 1000 (GGAC) | 20(C1) | VQR-SpBE3 |
| W713X | TGG | TAR | CCAAGGUGGACAUUUUUGUC | 1001 (TGG) | 20(C2) | SpBE3 |
| W714X | TGG | TAR | CAAAUCUGUACCACCAAGGU | 1002 (GGAC) | 20 (C12) | VQR-SpBE3 |
| W714X | TGG | TAR | GCAAAUCUGUACCACCAAGG | 1003 (TGG) | 20 (C13) | SpBE3 |

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs (PAM) | gRNA size (C edited) | BE type[a] |
|---|---|---|---|---|---|---|
| W724X | TGG | TAR | AAUUCCAGAUCAAGAAUUUG | 1004 (TGTG) | 20 (C6) | VQR-SpBE3 |
| W724X | TGG | TAR | GCAAUUCCAGAUCAAGAAUU | 1005 (TGTG) | 20 (C8) | VQR-SpBE3 |
| W724X | TGG | TAR | UCCAGAUCAAGAAUUUGUGU | 1006 (GCAAAT) | 20 (C3) | KKH-SaBE3 |
| W724X | TGG | TAR | UAUGGAGAGCAAUUCCAGAU | 1007 (CAAGAAT) | 20 (C16) | St1BE3 |
| W730X | TGG | TAR | CCAAUAUGGAGAGCAAUUCC | 1008 (AGAT) | 20(C2) | VQR-SpBE3 |
| W730X | TGG | TAR | UCCAAUAUGGAGAGCAAUUC | 1009 (CAG) | 20 (C3) | SpBE3 |
| W730X | TGG | TAR | UGAAUUUUAUCCAAUAUGGA | 1010 (GAG) | 20 (C12) | SpBE3 |
| W730X | TGG | TAR | UUGAAUUUUAUCCAAUAUGG | 1011 (AGAG) | 20 (C13) | EQR-SpBE3 |
| W730X | TGG | TAR | AUCCAAUAUGGAGAGCAAUU | 1012 (CCAGAT) | 20(C4) | KKH-SaBE3 |
| W730X | TGG | TAR | GAAUUUUAUCCAAUAUGGAG | 1013 (AGCAAT) | 20 (C11) | KKH-SaBE3 |
| Q805X | CAA | TAA | AUGAGUAUUCCAAGUAGGC | 1014 (TGG) | 20 (C12) | SpBE3 |
| Q805X | CAA | TAA | UGAGUAUUCCAAGUAGGCU | 1015 (GGAA) | 20 (C11) | VQR-SpBE3 |
| Q805X | CAA | TAA | CAAGUAGGCUGGAAUAUUUU | 1016 (TGAC) | 20 (C1) | VQR-SpBE3 |
| Q805X | CAA | TAA | AUGAGUAUUCCAAGUAGGC | 1017 (TGGAAT) | 20 (C12) | SaBE3 |
| W808X | TGG | TAR | AAAAAUAUUCCAGCCUACUU | 1018 (GGAA) | 20 (C11) | VQR-SpBE3 |
| W808X | TGG | TAR | CAAAAAUAUUCCAGCCUACU | 1019 (TGG) | 20 (C12) | SpBE3 |
| W808X | TGG | TAR | AAAAAUAUUCCAGCCUACUU | 1020 (GGAAAT) | 20 (C11) | KKH-SaBE3 |
| R835X | CGA | TGA | UUGUCAGUUCUGCGAUCAUU | 1021 (CAG) | 20 (C13) | SpBE3 |
| R835X | CGA | TGA | UGUCAGUUCUGCGAUCAUUC | 1022 (AGAC) | 20 (C12) | VQR-SpBE3 |
| R835X | CGA | TGA | AGUUCUGCGAUCAUUCAGAC | 1023 (TGG) | 20(C8) | SpBE3 |
| R835X | CGA | TGA | UCAGUUCUGCGAUCAUUCAG | 1024 (ACTGGT) | 20 (C10) | KKH-SaBE3 |
| R841X | CGA | TGA | GCUUUAGCUCCGAGUCUUC | 1025 (AAG) | 20 (C12) | SpBE3 |
| R841X | CGA | TGA | UUAGCUCCGAGUCUUCAAGU | 1026 (TGG) | 20 (C8) | SpBE3 |
| R841X | CGA | TGA | GCUCCGAGUCUUCAAGUUGG | 1027 (CAAAAT) | 20(C5) | KKH-SaBE3 |
| W849X | TGG | TAR | CCAGGAUUUUGCCAACUUGA | 1028 (AGAC) | 20(C2) | VQR-SpBE3 |

TABLE 4-continued

Exemplary NaV1.7 (SNA9A) Protective Loss-of-Function Mutations via Premature Stop Codons

| Residue Change | Codon Change | Res

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs (PAM) | gRNA size (C edited) | BE type[a] |
|---|---|---|---|---|---|---|
| Q1026X | CAA | TAA | AGGGAGAUAAGACAAGCAGA | 1056 (AGAT) | 20 (C13) | VQR-SpBE3 |
| Q1026X | CAA | TAA | GAUAAGACAAGCAGAAGAUC | 1057 (TGAA) | 20 (C8) | VQR-SpBE3 |
| Q1026X | CAA | TAA | AAGCAGAAGAUCUGAAUACU | 1058 (AAG) | 20 (C-1) | SpBE3 |
| Q1026X | CAA | TAA | AGAUAAGACAAGCAGAAGAU | 1059 (CTGAAT) | 20 (C9) | SaBE3 |
| Q1077X | CAA | TAA | GUGAUGGUCAAUCAUUUAUU | 1060 (CACAAT) | 20 (C9) | KKH-SaBE3 |
| W1161X | TGG | TAR | CAUACACAACCUGACAAGAA | 1061 (AGAC) | 20 (C1) | VQR-SpBE3 |
| W1161X | TGG | TAR | CCAUACACAACCUGACAAGA | 1062 (AAG) | 20(C2) | SpBE3 |
| W1161X | TGG | TAR | CCUCCAUACACAACCUGACA | 1063 (AGAA) | 20(C5) | VQR-SpBE3 |
| W1161X | TGG | TAR | ACCUCCAUACACAACCUGAC | 1064 (AAG) | 20(C6) | SpBE3 |
| W1161X | TGG | TAR | GAGAACCUCCAUACACAACC | 1065 (TGAC) | 20 (C10) | VQR-SpBE3 |
| W1161X | TGG | TAR | AACCUCCAUACACAACCUGA | 1066 (CAAGAAA) | 20(C7) | St1BE3 |
| Q1167X | CAA | TAA | CUCAUGCUGCCAAGUUAACA | 1067 (TAG) | 20 (C11) | SpBE3 |
| Q1167X | CAA | TAA | CUCAUGCUGCCAAGUUAACA | 1068 (TAGAGT) | 20 (C11) | SaBE3 |
| Q1167X | CAA | TAA | UCAUGCUGCCAAGUUAACAU | 1069 (AGAG) | 20 (C10) | EQR-SpBE3 |
| Q1167X | CAA | TAA | CAUGCUGCCAAGUUAACAUA | 1070 (GAG) | 20 (C9) | SpBE3 |
| Q1167X | CAA | TAA | CUGCCAAGUUAACAUAGAGU | 1071 (CAG) | 20 (C5) | SpBE3 |
| Q1167X | CAA | TAA | UGCCAAGUUAACAUAGAGUC | 1072 (AGG) | 20 (C4) | SpBE3 |
| Q1167X | CAA | TAA | GCCAAGUUAACAUAGAGUCA | 1073 (GGG) | 20 (C3) | SpBE3 |
| Q1167X | CAA | TAA | CCAAGUUAACAUAGAGUCAG | 1074 (GGAA) | 20 (C2) | VQR-SpBE3 |
| W1178/9X | TGG | TAR | CACCAGAUUUUUCCUUUCCC | 1075 (TGAC) | 20 (C4/1) | VQR-SpBE3 |
| W1193X | TGG | TAR | AACUGUGUUCAACAAUCUUG | 1076 (TAG) | 20(C-1) | SpBE3 |
| W1193X | TGG | TAR | CUUUCAAACCAACUGUGUUC | 1077 (AACAAT) | 20 (C10) | KKH-SaBE3 |
| W1245X | TGG | TAR | UCCAUUUUAGAAGCAUUUCC | 1078 (AGAA) | 20(C3) | VQR-SpBE3 |
| W1245X | TGG | TAR | AUCCAUUUUAGAAGCAUUUC | 1079 (CAG) | 20(C4) | SpBE3 |
| W1245X | TGG | TAR | CCAUAUGCUAUCCAUUUUAG | 1080 (AAG) | 20 (C13) | SpBE3 |
| W1245X | TGG | TAR | AUCCAUUUUAGAAGCAUUUC | 1081 (CAGAAT) | 20 (C4) | SaBE3 |
| W1245X | TGG | TAR | UAUCCAUUUUAGAAGCAUUU | 1082 (CCAGAAT) | 20 (C5) | St1BE3 |
| W1245X | TGG | TAR | AUAACCAUAUGCUAUCCAUU | 1083 (TTAGAAG) | 20 (C17) | St1BE3 |

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs (PAM) | gRNA size (C edited) | BE type[a] |
|---|---|---|---|---|---|---|
| W1245X | TGG | TAR | CAGCCAACACCAGGCAUUGG | 1084 (TGAA) | 20 (C9/3) | VQR-SpBE3 |
| W1245X | TGG | TAR | UCCAGCCAACACCAGGCAUU | 1085 (GGTG) | 20 (C11/5) | VQR-SpBE3 |
| W1245X | TGG | TAR | CAGCCAACACCAGGCAUUGG | 1086 (TGAAAT) | 20 (C9/3) | KKH-SaBE3 |
| W1245X | TGG | TAR | AAAUCCAGCCAACACCAGGC | 1087 (ATTGGT) | 20 (C14/8) | KKH-SaBE3 |
| W1245X | TGG | TAR | AUCCAGCCAACACCAGGCAU | 1088 (TGGTG) | 20 (C12/6) | St3BE3 |
| W1245X | TGG | TAR | AUCCAGCCAACACCAGGCAU | 1089 (TGG) | 20 (C12/6) | SpBE3 |
| W1332X | TGG | TAR | CAGAAUAUAAGACACACAAG | 1090 (TAG) | 20 (C1) | SpBE3 |
| W1332X | TGG | TAR | AGCCAGAAUAUAAGACACAC | 1091 (AAG) | 20 (C4) | SpBE3 |
| W1332X | TGG | TAR | UGAAUAUCAGCCAGAAUAUA | 1092 (AGAC) | 20 (C12) | VQR-SpBE3 |
| W1332X | TGG | TAR | CUGAAUAUCAGCCAGAAUAU | 1093 (AAG) | 20 (C13) | SpBE3 |
| W1332X | TGG | TAR | UCAGCCAGAAUAUAAGACAC | 1094 (ACAAGT) | 20 (C6) | KKH-SaBE3 |
| Q1363X | CAA | TAA | AGUCAAGUUCCAAAUCGUUC | 1095 (CGAA) | 20 (C4) | VQR-SpBE3 |
| Q1363X | CAA | TAA | AAGUCAAGUUCCAAAUCGUU | 1096 (CCGAAT) | 20 (C5) | SaBE3 |
| Q1378X | CAA | TAA | UGAAUGUUAGUCAAAAUGUG | 1097 (CGAT) | 20 (C12) | VQR-SpBE3 |
| Q1378X | CAA | TAA | AUGUUAGUCAAAAUGUGCGA | 1098 (TGG) | 20 (C9) | SpBE3 |
| Q1378X | CAA | TAA | UGUUAGUCAAAAUGUGCGAU | 1099 (GGAA) | 20 (C8) | VQR-SpBE3 |
| Q1378X | CAA | TAA | UAUGAAUGUUAGUCAAAAUG | 1100 (TGCGAT) | 20 (C14) | KKH-SaBE3 |
| R1381X | CGA | TGA | AAAUGUGCGAUGGAAAAACC | 1101 (TGAA) | 20 (C8) | VQR-SpBE3 |
| R1381X | CGA | TGA | UGUGCGAUGGAAAAACCUGA | 1102 (AAG) | 20 (C5) | SpBE3 |
| R1381X | CGA | TGA | GUGCGAUGGAAAAACCUGAA | 1103 (AGTG) | 20 (C4) | VQR-SpBE3 |
| R1381X | CGA | TGA | GCGAUGGAAAAACCUGAAAG | 1104 (TGAA) | 20 (C2) | VQR-SpBE3 |
| R1381X | CGA | TGA | AAUGUGCGAUGGAAAAACCU | 1105 (GAAAGT) | 20 (C7) | KKH-SaBE3 |
| W1382X | TGG | TAR | GGUUUUUCCAUCGCACAUUU | 1106 (TGAC) | 20 (C9) | VQR-SpBE3 |
| Q1401X | CAA | TAA | UAUUCUUAAAGGCAACUUUU | 1107 (AAG) | 20 (C13) | SpBE3 |
| Q1401X | CAA | TAA | AUUCUUAAAGGCAACUUUUA | 1108 (AGG) | 20 (C12) | SpBE3 |
| Q1401X | CAA | TAA | UUCUUAAAGGCAACUUUUAA | 1109 (GGG) | 20 (C11) | SpBE3 |

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs (PAM) | gRNA size (C edited) | BE type[a] |
|---|---|---|---|---|---|---|
| Q1401X | CAA | TAA | UCUUAAAGGCAACUUUUAAG | 1110 (GGAT) | 20 (C10) | VQR-SpBE3 |
| Q1401X | CAA | TAA | UAAAGGCAACUUUUAAGGGA | 1111 (TGG) | 20 (C7) | SpBE3 |
| Q1401X | CAA | TAA | AAAGGCAACUUUUAAGGGAU | 1112 (GGAC) | 20 (C6) | VQR-SpBE3 |
| Q1401X | CAA | TAA | GGCAACUUUUAAGGGAUGGA | 1113 (CGAT) | 20 (C3) | VQR-SpBE3 |
| Q1401X | CAA | TAA | AUUCUUAAAGGCAACUUUUA | 1114 (AGGGAT) | 20 (C12) | SaBE3 |
| Q1401X | CAA | TAA | AAGGCAACUUUUAAGGGAUG | 1115 (GACGAT) | 20 (C5) | KKH-SaBE3 |
| W1408X | TGG | TAR | AUCCCUUAAAAGUUGCCUUU | 1116 (AAG) | 20 (C-1) | SpBE3 |
| W1408X | TGG | TAR | AAUAAUCGUCCAUCCCUUAA | 1117 (AAG) | 20 (C11) | SpBE3 |
| W1408X | TGG | TAR | AUCCCUUAAAAGUUGCCUUU | 1118 (AAGAAT) | 20 (C-1) | SaBE3 |
| W1408X | TGG | TAR | AUAAUAAUCGUCCAUCCCUU | 1119 (AAAAGT) | 20 (C13) | KKH-SaBE3 |
| W1408X | TGG | TAR | CAUCCCUUAAAAGUUGCCUU | 1120 (TAAGAAT) | 20 (C1) | St1BE3 |
| Q1424X | CAG | TAG | GUAGACAAGCAGCCCAAAUA | 1121 (TGAA) | 20 (C10) | VQR-SpBE3 |
| Q1424X | CAG | TAG | AAGCAGCCCAAAUAUGAAUA | 1122 (TAG) | 20 (C4) | SpBE3 |
| Q1462X | CAA | TAA | CAUAGAUAAUUUCAACCAAC | 1123 (AGAA) | 20 (C13) | VQR-SpBE3 |
| Q1462X | CAA | TAA | AUAAUUUCAACCAACAGAAA | 1124 (AAG) | 20 (C8) | SpBE3 |
| Q1462X | CAA | TAA | UAAUUUCAACCAACAGAAAA | 1125 (AGAA) | 20 (C7) | VQR-SpBE3 |
| Q1462X | CAA | TAA | AUUUCAACCAACAGAAAAAG | 1126 (AAG) | 20 (C5) | SpBE3 |
| Q1462X | CAA | TAA | UUUCAACCAACAGAAAAAGA | 1127 (AGAT) | 20 (C4) | VQR-SpBE3 |
| Q1462X | CAA | TAA | AACCAACAGAAAAAGAAGAU | 1128 (AAG) | 20 (C-1) | SpBE3 |
| Q1462X | CAA | TAA | AAUUUCAACCAACAGAAAAA | 1129 (GAAGAT) | 20 (C6) | KKH-SaBE3 |
| Q1462X | CAA | TAA | UCAACCAACAGAAAAAGAAG | 1130 (ATAAGT) | 20 (C2) | KKH-SaBE3 |
| Q1462X | CAA | TAA | GAUAAUUUCAACCAACAGAA | 1131 (AAAGAAG) | 20 (C9) | St1BE3 |
| Q1463X | CAG | TAG | AUUUCAACCAACAGAAAAAG | 1132 (AAG) | 20 (C12) | SpBE3 |
| Q1463X | CAG | TAG | UUUCAACCAACAGAAAAAGA | 1133 (AGAT) | 20 (C11) | VQR-SpBE3 |
| Q1463X | CAG | TAG | AACCAACAGAAAAAGAAGAU | 1134 (AAG) | 20 (C7) | SpBE3 |
| Q1463X | CAG | TAG | AAUUUCAACCAACAGAAAAA | 1135 (GAAGAT) | 20 (C13) | KKH-SaBE3 |
| Q1463X | CAG | TAG | UCAACCAACAGAAAAAGAAG | 1136 (ATAAGT) | 20(C9) | KKH-SaBE3 |

TABLE 4-continued

Exemplary NaV1.7 (SNA9A) Protective Loss-of-Function Mutations via Premature Stop Codons

| Resid

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs (PAM) | gRNA size (C edited) | BE type[a] |
|---|---|---|---|---|---|---|
| Q1539/41X | CAA | TAA | GGUCAAAGUCAACAUAUGAC | 1164 (TGAAGT) | 20 (C4/10) | KKH-SaBE3 |
| Q1541X | CAA | TAA | GGUCAAAGUCAACAUAUGAC | 1165 (TGAA) | 20 (C10) | VQR-SpBE3 |
| Q1541X | CAA | TAA | UCAAAGUCAACAUAUGACUG | 1166 (AAG) | 20 (C8) | SpBE3 |
| Q1541X | CAA | TAA | GGUCAAAGUCAACAUAUGAC | 1167 (TGAAGT) | 20 (C4/10) | KKH-SaBE3 |
| W1549X | TGG | TAR | AUUUAUCCAAUAUAAAACUU | 1168 (CAG) | 20 (C8) | SpBE3 |
| W1549X | TGG | TAR | ACAUUUAUCCAAUAUAAAAC | 1169 (TTCAGT) | 20 (C10) | KKH-SaBE3 |
| W1578X | TGG | TAR | CCAUCCUACAGUGAAGUAGU | 1170 (AGTG) | 20(C2) | VQR-SpBE3 |
| W1578X | TGG | TAR | UCCAUCCUACAGUGAAGUAG | 1171 (TAG) | 20(C3) | SpBE3 |
| W1578X | TGG | TAR | UAUUCCAUCCUACAGUGAAG | 1172 (TAG) | 20(C6) | SpBE3 |
| W1578X | TGG | TAR | AAAUAUUCCAUCCUACAGUG | 1173 (AAG) | 20(C9) | SpBE3 |
| W1578X | TGG | TAR | AAAAAUAUUCCAUCCUACAG | 1174 (TGAA) | 20 (C11) | VQR-SpBE3 |
| W1578X | TGG | TAR | UCAAAAAUAUUCCAUCCUAC | 1175 (AGTG) | 20 (C13) | VQR-SpBE3 |
| W1578X | TGG | TAR | AUUCCAUCCUACAGUGAAGU | 1176 (AGTAGT) | 20(C5) | KKH-SaBE3 |
| W1578X | TGG | TAR | AAUAUUCCAUCCUACAGUGA | 1177 (AGTAGT) | 20(C8) | KKH-SaBE3 |
| W1578X | TGG | TAR | AAAAAUAUUCCAUCCUACAG | 1178 (TGAAGT) | 20 (C11) | KKH-SaBE3 |
| W1578X | TGG | TAR | AAAUCAAAAAUAUUCCAUCC | 1179 (TACAGT) | 20 (C16) | KKH-SaBE3 |
| R1610X | CGA | TGA | UUCCGAGUGAUCCGUCUUGC | 1180 (CAG) | 20(C4) | SpBE3 |
| R1610X | CGA | TGA | UCCGAGUGAUCCGUCUUGCC | 1181 (AGG) | 20(C3) | SpBE3 |
| R1610X | CGA | TGA | CCGAGUGAUCCGUCUUGCCA | 1182 (GGAT) | 20(C2) | VQR-SpBE3 |
| R1610X | CGA | TGA | UUCCGAGUGAUCCGUCUUGC | 1183 (CAGGAT) | 20(C4) | SaBE3 |
| R1619X | CGA | TGA | GAUUGGCCGAAUCCUACGUC | 1184 (TAG) | 20(C8) | SpBE3 |
| R1619X | CGA | TGA | CCGAAUCCUACGUCUAGUCA | 1185 (AAG) | 20(C2) | SpBE3 |
| R1619X | CGA | TGA | CGAAUCCUACGUCUAGUCAA | 1186 (AGG) | 20(C1) | SpBE3 |
| R1619X | CGA | TGA | GAAUCCUACGUCUAGUCAAA | 1187 (GGAG) | 20(C-1) | EQR-SpBE3 |
| R1619X | CGA | TGA | AGGAUUGGCCGAAUCCUACG | 1188 (TCTAGT) | 20 (C10) | KKH-SaBE3 |
| R1619X | CGA | TGA | CGAAUCCUACGUCUAGUCAA | 1189 (AGGAG) | 20 (C1) | St3BE3 |
| Q1693X | CAA | TAA | UUCCAAAUUACAACCUCUGC | 1190 (TGG) | 20 (C4) | SpBE3 |
| Q1693X | CAA | TAA | AAAUUACAACCUCUGCUGGC | 1191 (TGG) | 20 (C-1) | SpBE3 |
| W1700X | TGG | TAR | AGCCAGCAGAGGUUGUAAUU | 1192 (TGG) | 20 (C1) | SpBE3 |

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs (PAM) | gRNA size (C edited) | BE type[a] |
| --- | --- | --- | --- | --- | --- | --- |
| W1700X | TGG | TAR | CAAUCCAUCCCAGCCAGCAG | 1193 (AGG) | 20 (C11) | SpBE3 |
| W1700X | TGG | TAR | GCAAUCCAUCCCAGCCAGCA | 1194 (GAG) | 20 (C12) | SpBE3 |
| W1700X | TGG | TAR | AGCAAUCCAUCCCAGCCAGC | 1195 (AGAG) | 20 (C13) | EQR-SpBE3 |
| W1700X | TGG | TAR | CCAUCCCAGCCAGCAGAGGU | 1196 (TGTAAT) | 20(C7) | KKH-SaBE3 |
| W1700X | TGG | TAR | AGCAAUCCAUCCCAGCCAGC | 1197 (AGAGGT) | 20 (C13) | KKH-SaBE3 |
| W1786X | TGG | TAR | AAACCUCAUAGAACAUCUCA | 1198 (AAG) | 20 (C-1) | SpBE3 |
| W1786X | TGG | TAR | AAACUUCUCCCAAACCUCAU | 1199 (AGAA) | 20 (C11) | VQR-SpBE3 |
| W1786X | TGG | TAR | CAAACUUCUCCCAAACCUCA | 1200 (TAG) | 20 (C12) | SpBE3 |
| W1786X | TGG | TAR | CCAAACCUCAUAGAACAUCU | 1201 (CAAAGT) | 20 (C2) | KKH-SaBE3 |
| W1786X | TGG | TAR | UCAAACUUCUCCCAAACCUC | 1202 (ATAGAAC) | 20 (C13) | St1BE3 |
| Q1795X | CAG | TAG | CCCGAUGCGACCCAGUUUAU | 1203 (AGAG) | 20 (C13) | EQR-SpBE3 |
| Q1795X | CAG | TAG | CCGAUGCGACCCAGUUUAUA | 1204 (GAG) | 20 (C12) | SpBE3 |
| Q1822X | CAG | TAG | CAAAGUCCAGCUCAUUGCCA | 1205 (TGG) | 20(C8) | SpBE3 |
| Q1822X | CAG | TAG | AAAGUCCAGCUCAUUGCCAU | 1206 (GGAT) | 20 (C7) | VQR-SpBE3 |
| Q1822X | CAG | TAG | ACAAAGUCCAGCUCAUUGCC | 1207 (ATGGAT) | 20(C9) | SaBE3 |
| Q1862X | CAG | TAG | UCUCUUCGUUCACAGAUGGA | 1208 (AGAA) | 20 (C13) | VQR-SpBE3 |
| Q1862X | CAG | TAG | CUUCGUUCACAGAUGGAAGA | 1209 (AAG) | 20 (C10) | SpBE3 |
| Q1862X | CAG | TAG | UUCGUUCACAGAUGGAAGAA | 1210 (AGG) | 20 (C9) | SpBE3 |
| Q1862X | CAG | TAG | UCUUCGUUCACAGAUGGAAG | 1211 (AAAGGT) | 20 (C11) | KKH-SaBE3 |
| Q1888X | CAA | TAA | CUAAAACGGAAACAAGAGGA | 1212 (TGTG) | 20 (C13) | VQR-SpBE3 |
| Q1897X | CAG | TAG | ACUGUCAUUCAGCGUGCUUA | 1213 (TAG) | 20 (C10) | SpBE3 |
| Q1897X | CAG | TAG | CUGUCAUUCAGCGUGCUUAU | 1214 (AGAC) | 20(C9) | VQR-SpBE3 |
| Q1907X | CAA | TAA | CAAAAUGUCAAAAUAUAUC | 1215 (AAG) | 20 (C1) | SpBE3 |
| Q1907X | CAA | TAA | ACCGCUUAAGGCAAAAUGUC | 1216 (AAT) | 20 (C12) | KKH-SaBE3 |
| Q1907X | CAA | TAA | GGCAAAAUGUCAAAAUAUA | 1217 (TCAAGT) | 20 (C3) | KKH-SaBE3 |

TABLE 4-continued

Exemplary NaV1.7 (SNA9A) Protective Loss-of-Function Mutations via Premature Stop Codons

| Residue Change | Codon Change | Resulting Codon(s) | Programmable guide-RNA sequence | SEQ ID NOs (PAM) | gRNA size (C edited) | BE type[a] |
|---|---|---|---|---|---|---|
| Q1971X | CAA | TAA | GAAAUAUGAACAAGACAGAA | 1218 (CAG) | 20 (C11) | SpBE3 |
| Q1971X | CAA | TAA | AAAUAUGAACAAGACAGAAC | 1219 (AGAA) | 20 (C10) | VQR-SpBE3 |
| Q1971X | CAA | TAA | AUGAACAAGACAGAACAGAA | 1220 (AAG) | 20 (C6) | SpBE3 |
| Q1971X | CAA | TAA | UGAACAAGACAGAACAGAAA | 1221 (AGG) | 20 (C5) | SpBE3 |
| Q1971X | CAA | TAA | GAACAAGACAGAACAGAAAA | 1222 (GGAA) | 20 (C4) | VQR-SpBE3 |
| Q1971X | CAA | TAA | ACAAGACAGAACAGAAAAGG | 1223 (AAG) | 20 (C2) | SpBE3 |
| Q1971X | CAA | TAA | CAAGACAGAACAGAAAAGGA | 1224 (AGAC) | 20 (C1) | VQR-SpBE3 |
| Q1971X | CAA | TAA | AGAAAUAUGAACAAGACAGA | 1225 (ACAGAAA) | 20 (C12) | St1BE3 |

[a]BE types: SpBE3 = APOBEC1-SpCas9n-UGI; VQR-SpBE3 = APOBEC1-VQR-SpCas9n-UGI; EQR-SpBE3 = APOBEC1-EQR-SpCas9n-UGI; VRER-SpBE3 = APOBEC1-VRER-SpCas9n-UGI; SaBE3 = APOBEC1-SaCas9n-UGI; KKH-SaBE3 = APOBEC1-KKH-SaCas9n-UGI; St3BE3 = APOBEC1-St3Cas9n-UGI; St1BE3 = APOBEC1-St1Cas9n-UGI.

Target Base in Non-coding Region—Splicing Variants

Some aspects of the present disclosure provide strategies of reducing the activity of ion channels (e.g., ion channels in in DRG neurons) via preventing the ion channel mRNA maturation and production. In some embodiments, such strategies involve alterations of splicing sites in the ion channel gene. Altered splicing site may lead to altered splicing and maturation of the ion channel mRNA. For example, in some embodiments, an altered splicing site may lead to the skipping of an exon, in turn leading to a truncated protein product or an altered reading frame. In some embodiments, an altered splicing site may lead to translation of an intron sequence and premature translation termination when an in frame stop codon is encountered by the translating ribosome in the intron. In some embodiments, a start codon is edited and protein translation initiates at the next ATG codon, which may not be in the correct coding frame.

Figure 3:
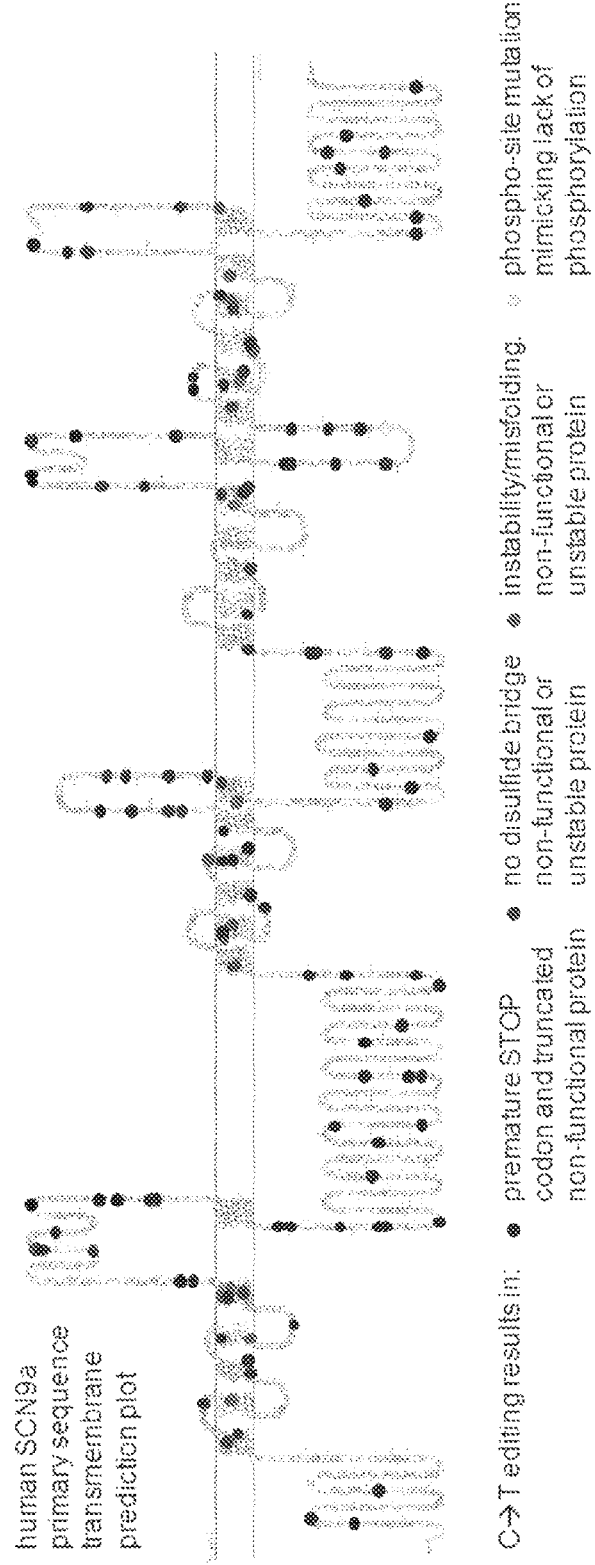
FIG. 3 shows a two-dimensional representation of the primary amino acid sequence of an isoform of NaV1.7/SCN9A, highlighting the transmembrane regions. The circles show non-limiting examples of variants that can be generated by genome modifications using cytidine deaminase base editing, which can be applied to modify the NaV1.7/SCN9A gene and afferent pain signals. The NaV1.7/Scn9A ion channel is shown as a non-limiting example of ion channels of DRG neurons. Other possible modifications, such as intron/exon junctions are not shown for clarity (see, e.g., FIG. 4).
Figure 4A:
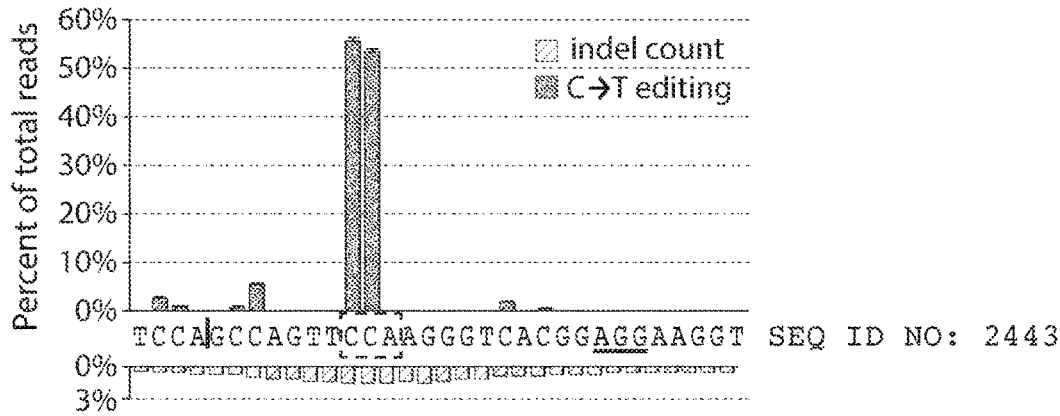
FIGS. 4A-4B.
Figure 4A:
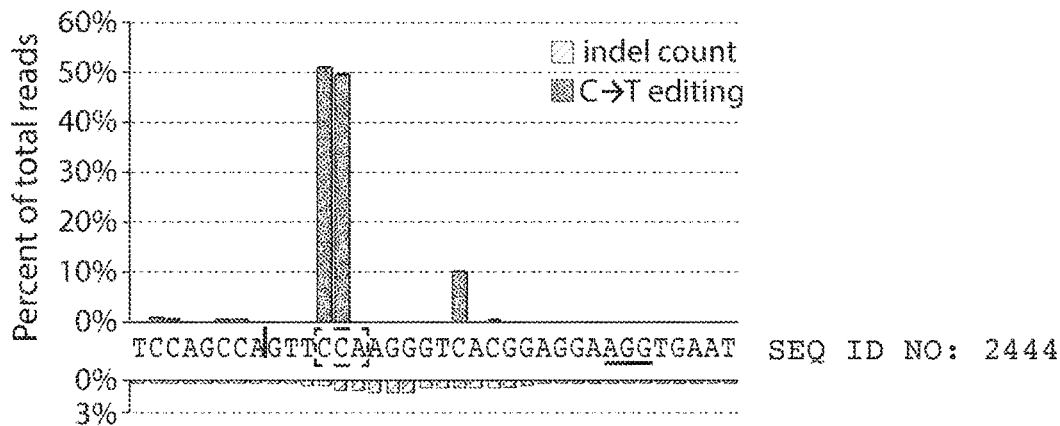
Figure 4A:
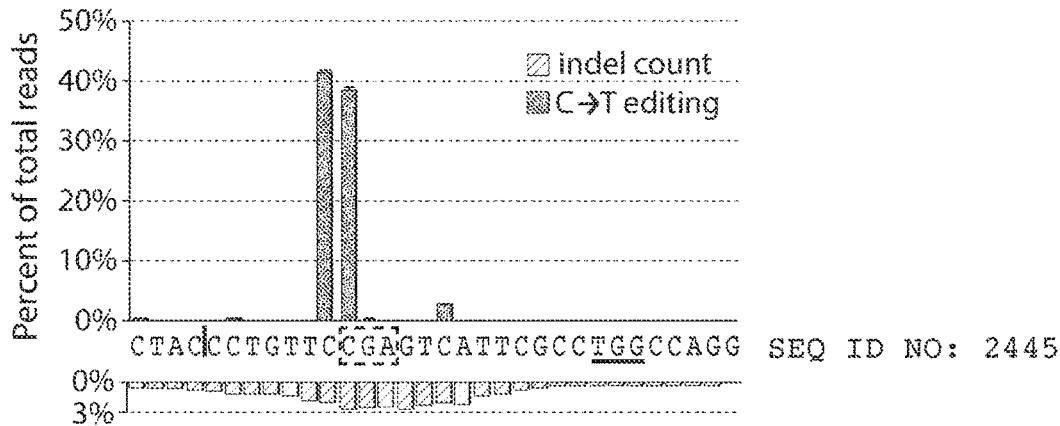
Figure 4B:
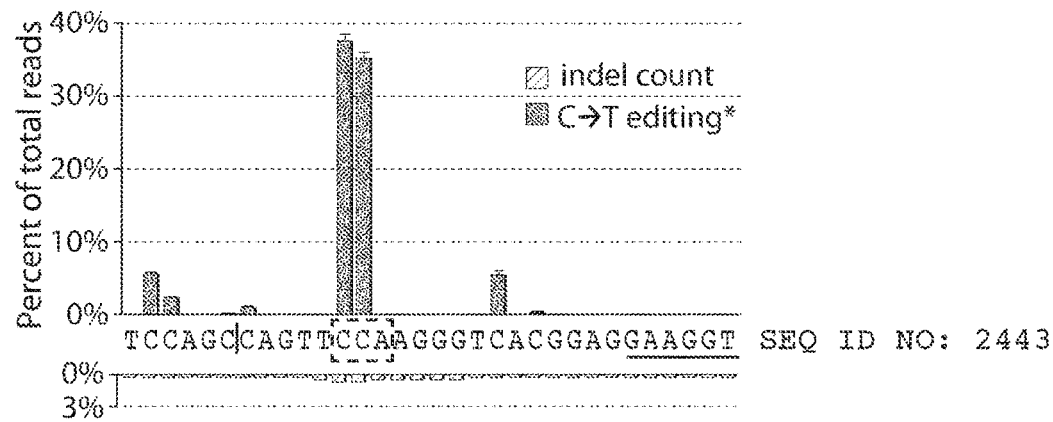
Figure 4B:
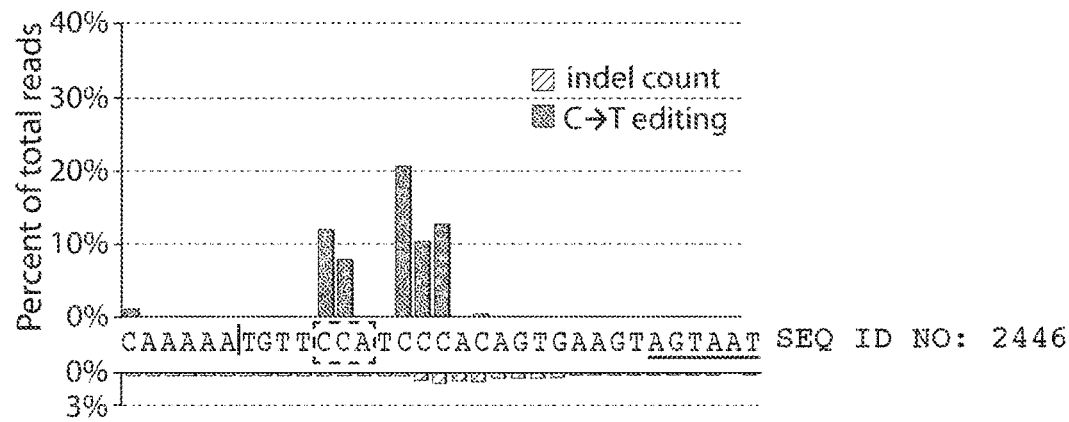
Figure 4B:
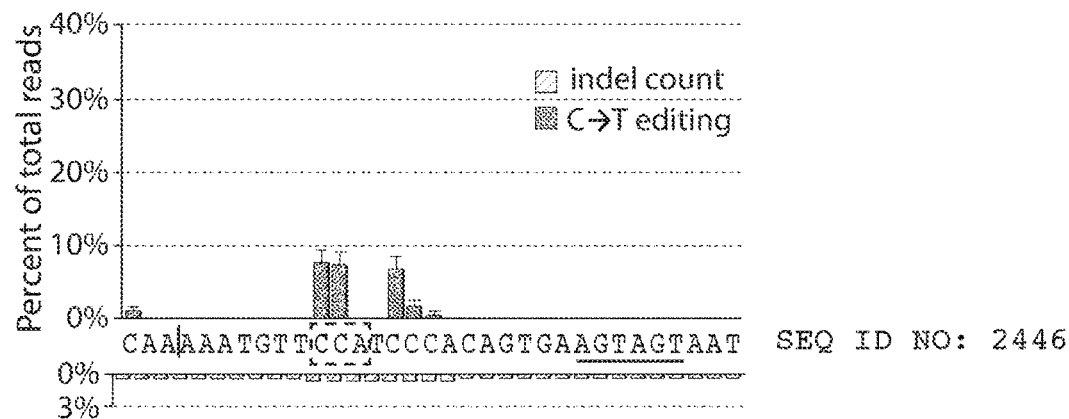

The splicing sites typically comprises an intron donor site, a Lariat branch point, and an intron acceptor site. The mechanism of splicing are familiar to those skilled in the art. As illustrated in FIG. 3, the intron donor site has a consensus sequence of GGGTRAGT, and the C bases paired with the G bases in the intron donor site consensus sequence may be targeted by a nucleobase editors described herein, thereby altering the intron donor site. The Lariat branch point also has consensus sequences, e.g., YTRAC, wherein Y is a pyrimidine, and R is a purine. The C base in the Lariat branch point consensus sequence may be targeted by the nucleobase editors, leading to the skipping of the following exon. The intron acceptor site has a consensus sequence of YNCAGG, wherein Y is a pyrimidine, and N is any nucleotide. The C base of the consensus sequence of the intron acceptor site, and the C base paired with the G bases in the consensus sequence of the intron acceptor site may be targeted by the nucleobase editors described herein, thereby altering the intron acceptor site, in turn leading the skipping of an exon. General strategies of altering the splicing sites of the ion channel gene are described in Table 5.

TABLE 5

Exemplary Alteration of Intron-Exon Junction via Base Editing

| Target site | Consensus Sequence | Base-editing reaction (s) | Edited sequence | Outcome |
|---|---|---|---|---|
| Intron donor | GGGTRAGT (example) | $2^{nd}$ or $3^{rd}$ base C to T on complementary strand | GAGTRAGT (example) | Intron sequence is translated as exon, in frame premature STOP codon |
| Lariat branch point | YTRAC (example) | $5^{th}$ base C to T on coding strand | YTRAT (example) | The following exon is skipped from the mature mRNA, which may affect the coding frame |
| Intron acceptor | Y(rich)NCAGG (example) | $2^{nd}$ to last base C to T on complementary strand | Y(rich)NCAAG (example) | The exon is skipped from the mature mRNA, which may affect the coding frame |

TABLE 5-continued

Exemplary Alteration of Intron-Exon Junction via Base Editing

| Target site | Consensus Sequence | Base-editing reaction (s) | Edited sequence | Outcome |
|---|---|---|---|---|
| Start codon | ATG (Met/M) | 3$^{rd}$ base C to T on complementary strand | ATA (Ile/I) | The next ATG is used as start codon, which may affect the coding frame |

Provided in Table 6 are non-limiting examples of alterations that may be made to non-coding regions (e.g., splicing sites) in the SCN9A gene using nucleobase editors and the guide sequences that may be used for each alteration.

TABLE 6

Alteration of Intron/Exon Junctions in NaV1.7 (SCN9A) Gene via Base Editing

| Target site* | Genome target seq. / junction | Programmable guide-RNA sequence | SEQ ID NOs | (PAM) | gRNA size (C edited) | BE type$^a$ |
|---|---|---|---|---|---|---|
| donor, intron 1 | CTAGGTTGCAAgtaagtgcctttt (SEQ ID NO: 1457) | UUACUUGCAACCUAGCCCGC | 1226 | (CGAT) | 20(C4) | VQR-SpBE3 |
| | | AAAGGCACUUACUUGCAACC | 1227 | (TAG) | 20(C12) | SpBE3 |
| | | ACUUACUUGCAACCUAGCCC | 1228 | (GCCGAT) | 20(C6) | KKH-SaBE3 |
| acceptor, intron 1 | ctttgtttccatccagGCCTCTT (SEQ ID NO: 1458) | AGAGGCCUGGAUGGAAACAA | 1229 | (AGAA) | 20(C6/7) | VQR-SpBE3 |
| | | AAGAGGCCUGGAUGGAAACA | 1230 | (AAG) | 20(C7/8) | SpBE3 |
| | | AGAGGCCUGGAUGGAAACAA | 1231 | (AGAAAT) | 20(C6/7) | KKH-SaBE3 |
| | | UAAGAGGCCUGGAUGGAAAC | 1232 | (AAAGAAA) | 20(C8/9) | St1BE3 |
| donor, intron 2 | CTATGCAGACAAAAAGgtgagtt (SEQ ID NO: 1459) | CCUUUUUGUCUGCAUAGUAG | 1233 | (GGG) | 20(C1/2) | SpBE3 |
| | | ACCUUUUUGUCUGCAUAGUA | 1234 | (GGG) | 20(C2/3) | SpBE3 |
| | | CACCUUUUUGUCUGCAUAGU | 1235 | (AGG) | 20(C3/4) | SpBE3 |
| | | UCACCUUUUUGUCUGCAUAG | 1236 | (TAG) | 20(C4/5) | SpBE3 |
| | | AACUCACCUUUUUGUCUGCA | 1237 | (TAG) | 20(C7/8) | SpBE3 |
| | | CACCUUUUUGUCUGCAUAGU | 1238 | (AGGGGT) | 20(C3/4) | SaBE3 |
| | | UAAACUCACCUUUUUGUCUG | 1239 | (CATAGT) | 20(C9/10) | KKH-SaBE3 |
| | | CACCUUUUUGUCUGCAUAGU | 1240 | (AGGGG) | 20(C3/4) | St3BE3 |
| acceptor, intron 2 | cttttttcctcctgcagACTTTCA (SEQ ID NO: 1460) | UCUGCAGGAGGAAAAAGAAA | 1241 | (GGAT) | 20(C2) | VQR-SpBE3 |
| | | GUCUGCAGGAGGAAAAAGAA | 1242 | (AGG) | 20(C3) | SpBE3 |
| | | AGUCUGCAGGAGGAAAAAGA | 1243 | (AAG) | 20(C4) | SpBE3 |
| | | GAAAGUCUGCAGGAGGAAAA | 1244 | (AGAA) | 20(C7) | VQR-SpBE3 |
| | | UGAAAGUCUGCAGGAGGAAA | 1245 | (AAG) | 20(C8) | SpBE3 |
| | | UACUAUGAAAGUCUGCAGGA | 1246 | (GGAA) | 20(C13) | VQR-SpBE3 |
| | | AGUCUGCAGGAGGAAAAAGA | 1247 | (AAGGAT) | 20(C4) | SaBE3 |
| | | AUGAAAGUCUGCAGGAGGAA | 1248 | (AAAGAAA) | 20(C9) | St1BE3 |
| donor, intron 3 | TAGTACACTCtatatccttttaaaaat (SEQ ID NO: 1461) | CACUCAUAUCCUUUUAAAAA | 1249 | (TGAT) | 20(C3/5) | VQR-SpBE3 |
| | | UAGUACACUCAUAUCCUUUU | 1250 | (AAAAAT) | 20(CE00) | KKH-SaBE3 |
| | | UACACUCAUAUCCUUUUAAA | 1251 | (AATGAT) | 20(C5/7) | KKH-SaBE3 |
| acceptor, intron 3 | tgattctaagctacCTTATTCAG (SEQ ID NO: 1462) | UGAUUCUAAGCUACCUUAUU | 1252 | (CAG) | 20(C11/14) | SpBE3 |
| donor, intron 4 | CCAAAAATGTCGAgtaagtgggt (SEQ ID NO: 1463) | CUUACUCGACAUUUUUGGUC | 1253 | (CAG) | 20(C5) | SpBE3 |
| | | ACCCACUUACUCGACAUUUU | 1254 | (TGG) | 20(C10) | SpBE3 |
| | | ACUCGACAUUUUUGGUCCAG | 1255 | (TCCGGT) | 20(C2) | KKH-SaBE3 |
| | | CACUUACUCGACAUUUUUGG | 1256 | (TCCAGT) | 20(C7) | KKH-SaBE3 |
| | | AUACCCACUUACUCGACAUU | 1257 | (TTTGGT) | 20(C12) | KKH-SaBE3 |
| acceptor, intron 4 | atcttgtgtttagGTACACTTTTA (SEQ ID NO: 1464) | CCUAAACACAAGAUUCCAUU | 1258 | (GGG) | 20(C1/2) | SpBE3 |
| | | ACCUAAACACAAGAUUCCAU | 1259 | (TGG) | 20(C2/3) | SpBE3 |
| | | UAAAAGUGUACCUAAACACA | 1260 | (AGAT) | 20(C11/12) | VQR-SpBE3 |
| | | GUAAAAGUGUACCUAAACAC | 1261 | (AAG) | 20(C12/13) | SpBE3 |
| | | ACCUAAACACAAGAUUCCAU | 1262 | (TGGGAT) | 20(C2/3) | SaBE3 |
| | | AGUAAAAGUGUACCUAAACA | 1263 | (CAAGAT) | 20(C13/14) | KKH-SaBE3 |
| donor, intron 5 | ATTGTTTTTGCgtaagtactttcagc (SEQ ID NO: 1465) | UACUUACGCAAAAACAAUGA | 1264 | (CGAC) | 20(C7) | VQR-SpBE3 |
| | | AAGUACUUACGCAAAAACAA | 1265 | (TGAC) | 20(C10) | VQR-SpBE3 |
| | | UUACGCAAAAACAAUGACGA | 1266 | (CAAAAT) | 20(C4) | KKH-SaBE3 |
| | | GCUGAAAGUACUUACGCAAA | 1267 | (AACAAT) | 20(C15) | KKH-SaBE3 |
| acceptor, intron 5 | atttaattctacagGTATTTAACAGA (SEQ ID NO: 1466) | AAUACCUGUAGAAUUAAAUC | 1268 | (AGAA) | 20(C5/6) | VQR-SpBE3 |
| | | AAAUACCUGUAGAAUUAAAU | 1269 | (CAG) | 20(C6/7) | SpBE3 |
| | | AAAUACCUGUAGAAUUAAAU | 1270 | (CAGAAT) | 20(C6/7) | SaBE3 |
| | | UCUGUUAAAUACCUGUAGAA | 1271 | (TTAAAT) | 20(C12/13) | KKH-SaBE3 |
| | | UAAAUACCUGUAGAAUUAAA | 1272 | (TCAGAAT) | 20(C7/8) | St1BE3 |

TABLE 6-continued

Alteration of Intron/Exon Junctions in NaV1.7 (SCN9A) Gene via Base Editing

| Target site* | Genome target seq. / junction | Programmable guide-RNA sequence | SEQ ID NOs | (PAM) | gRNA size (C edited) | BE type[a] |
|---|---|---|---|---|---|---|
| donor, intron 6 | CTGTAATCCCAGgtaagaagtaa (SEQ ID NO: 1467) | CUUACCUGGGAUUACAGAAA | 1273 | (TAG) | 20(C5/6) | SpBE3 |
| | | UACUUCUUACCUGGGAUUAC | 1274 | (AGAA) | 20(C10/11) | VQR-SpBE3 |
| | | UUACUUCUUACCUGGGAUUA | 1275 | (CAG) | 20(C11/12) | SpBE3 |
| | | UUCUUACCUGGGAUUACAGA | 1276 | (AATAGT) | 20(C7/8) | KKH-SaBE3 |
| | | UACUUCUUACCUGGGAUUAC | 1277 | (AGAAAT) | 20(C10/11) | KKH-SaBE3 |
| | | AUUACUUCUUACCUGGGAUU | 1278 | (ACAGAAA) | 20(C12/13) | St1BE3 |
| acceptor, intron 6 | ctcccatttttcagGCCTGAAGAC (SEQ ID NO: 1468) | GCCUGAAAAUGGGAGAAAAA | 1279 | (AGTG) | 20(C2/3) | VQR-SpBE3 |
| | | GGCCUGAAAAUGGGAGAAAA | 1280 | (AAG) | 20(C3/4) | SpBE3 |
| | | UCUUCAGGCCUGAAAAUGGG | 1281 | (AGAA) | 20(C9/10) | VQR-SpBE3 |
| | | GUCUUCAGGCCUGAAAAUGG | 1282 | (GAG) | 20(C10/11) | SpBE3 |
| | | UGUCUUCAGGCCUGAAAAUG | 1283 | (GGAG) | 20(C11/12) | EQR-SpBE3 |
| | | UUGUCUUCAGGCCUGAAAAU | 1284 | (GGG) | 20(C12/13) | SpBE3 |
| | | CAGGCCUGAAAAUGGGAGAA | 1285 | (AAAAGT) | 20(C5/6) | KKH-SaBE3 |
| | | UGUCUUCAGGCCUGAAAAUG | 1286 | (GGAGAAA) | 20(C11/12) | St1BE3 |
| | | UUGUCUUCAGGCCUGAAAAU | 1287 | (GGGAG) | 20(C12/13) | St3BE3 |
| acceptor, intron 7 | ttcttcttcaacagAATATTTTA (SEQ ID NO: 1469) | CUGUUGAAGAAGAAUUUGAA | 1288 | (CAG) | 20(C1) | SpBE3 |
| | | UAUUCUGUUGAAGAAGAAUU | 1289 | (TGAA) | 20(C5) | VQR-SpBE3 |
| | | UAAAAUAUUCUGUUGAAGAA | 1290 | (AGAA) | 20(C11) | VQR-SpBE3 |
| | | AUAAAAAUAUUCUGUUGAAG | 1291 | (AAG) | 20(C12) | SpBE3 |
| | | UUCUGUUGAAGAAGAAUUUG | 1292 | (AACAGT) | 20(C3) | KKH-SaBE3 |
| | | AUAAAAAUAUUCUGUUGAAG | 1293 | (AAGAAT) | 20(C12) | SaBE3 |
| | | AAUAAAAAUAUUCUGUUGAA | 1294 | (GAAGAAT) | 20(C13) | St1BE3 |
| | | AGUAAUAAAAAUAUUCUGUU | 1295 | (GAAGAAG) | 20(C16) | St1BE3 |
| donor, intron 8 | CACAGATTCAGGgtatgtaatatt (SEQ ID NO: 1470) | UACAUACCCUGAAUCUGUGC | 1296 | (TGAA) | 20(C7/8) | VQR-SpBE3 |
| | | AAUAUUACAUACCCUGAAUC | 1297 | (TGTG) | 20(C12/13) | VQR-SpBE3 |
| acceptor, intron 8 | cttttctcgtgtgtagTCAGTGTC (SEQ ID NO: 1471) | ACACUGACUACACACGAGAA | 1298 | (AGAA) | 20(C8) | VQR-SpBE3 |
| | | GACACUGACUACACACGAGA | 1299 | (AAG) | 20(C9) | SpBE3 |
| | | CUGGACACUGACUACACACG | 1300 | (AGAA) | 20(C12) | VQR-SpBE3 |
| donor, intron 9 | CTTTACCAACAGgtgagtaccaa (SEQ ID NO: 1472) | CCUGUUGGUAAAGGUUUUCC | 1301 | (CAG) | 20(C1/2) | SpBE3 |
| | | UGGUACUCACCUGUUGGUAA | 1302 | (AGG) | 20(C10/11) | SpBE3 |
| | | UUGGUACUCACCUGUUGGUA | 1303 | (AAG) | 20(C11/12) | SpBE3 |
| | | CACCUGUUGGUAAAGGUUUU | 1304 | (CCCAGT) | 20(C3/4) | KKH-SaBE3 |
| | | CUUGGUACUCACCUGUUGGU | 1305 | (AAAGGT) | 20(C12/13) | KKH-SaBE3 |
| acceptor, intron 9 | ccattttttccctagACGCTGCGT (SEQ ID NO: 1473) | CGCAGCGUCUAGGGAAAAAU | 1306 | (GGAA) | 20(C9) | VQR-SpBE3 |
| | | ACGCAGCGUCUAGGGAAAAA | 1307 | (TGG) | 20(C10) | SpBE3 |
| | | CGCAGCGUCUAGGGAAAAAU | 1308 | (GGAAAT) | 20(C9) | KKH-SaBE3 |
| | | GCAGCACGCAGCGUCUAGGG | 1309 | (AAAAAT) | 20(C15) | KKH-SaBE3 |
| acceptor, intron 10 | cttggcccaaccagGCAATTGCA (SEQ ID NO: 1474) | GCAAUUGCCUGGUUGGGCCA | 1310 | (AGAC) | 20(C8/9) | VQR-SpBE3 |
| | | UGCAAUUGCCUGGUUGGGCC | 1311 | (AAG) | 20(C9/10) | SpBE3 |
| donor, intron 11 | CCCCCAATCAGGgtaccaccaaa (SEQ ID NO: 1475) | GGUGGUACCUGAUUGGGGGU | 1312 | (AGAC) | 20(C8/9) | VQR-SpBE3 |
| | | GGGUGGUACCUGAUUGGGGG | 1313 | (TAG) | 20(C9/10) | SpBE3 |
| | | UUUGGGUGGUACCUGAUUGG | 1314 | (GGG) | 20(C12/13) | SpBE3 |
| | | AAUUUGGGUGGUACCUGAUU | 1315 | (GGGGGT) | 20(C14/15) | SaBE3 |
| | | AAUUUGGGUGGUACCUGAUU | 1316 | (GGGGG) | 20(C14/15) | St3BE3 |
| acceptor, intron 11 | atttttctgcagTCACCACTCAGCAT (SEQ ID NO: 1476) | AUGCUGAGUGGUGACUGCAG | 1317 | (AAAAAT) | 20(C15) | KKH-SaBE3 |
| donor, intron 12a | TTCTGCCAGAGgtgataatagata (SEQ ID NO: 1477) | UCUAUUAUCACCUCUGGCAG | 1318 | (AAG) | 20(C11/12) | SpBE3 |
| | | UAUCUAUUAUCACCUCUGGC | 1319 | (AGAA) | 20(C13/14) | VQR-SpBE3 |
| | | CUUAUCUAUUAUCACCUCUG | 1320 | (GCAGAAG) | 20(C15/16) | St1BE3 |
| donor, intron 12b | CTGATGACAGCgtaaggacg (SEQ ID NO: 1478) | CGUCCUUACGCUGUCAUCAG | 1321 | (AAG) | 20(C9) | SpBE3 |
| | | AACGUCCUUACGCUGUCAUC | 1322 | (AGAA) | 20(C11) | VQR-SpBE3 |
| | | AAACGUCCUUACGCUGUCAU | 1323 | (CAG) | 20(C12) | SpBE3 |
| | | AACGUCCUUACGCUGUCAUC | 1324 | (AGAAGT) | 20(C11) | KKH-SaBE3 |
| | | AAAACGUCCUUACGCUGUCA | 1325 | (TCAGAAG) | 20(C13) | St1BE3 |
| acceptor, intron 13 | attgattttttttttagGGCACGACC (SEQ ID NO: 1479) | GUGCCCUAAAAAAAAAAUCA | 1326 | (ATTAAT) | 20(C5/6) | KKH-SaBE3 |
| | | GGUCGUGCCCUAAAAAAAAA | 1327 | (ATCAAT) | 20(C9/10) | KKH-SaBE3 |
| | | GAUUGGUCGUGCCCUAAAAA | 1328 | (AAAAAT) | 20(C13/14) | KKH-SaBE3 |
| donor, intron 13 | CACTGTGGAAGgtatgtaataatc (SEQ ID NO: 1480) | GAUUAUUACAUACCUUCCAC | 1329 | (AGTG) | 20(C13/14) | VQR-SpBE3 |
| | | ACAUACCUUCCACAGUGUUU | 1330 | (GTTAAT) | 20(C6/7) | KKH-SaBE3 |

TABLE 6-continued

Alteration of Intron/Exon Junctions in NaV1.7 (SCN9A) Gene via Base Editing

| Target site* | Genome target seq. / junction | Programmable guide-RNA sequence | SEQ ID NOs | (PAM) | gRNA size (C edited) | BE type[a] |
|---|---|---|---|---|---|---|
| acceptor, intron 13 | cttttttctcccagAACTTGAAG (SEQ ID NO: 1481) | GUUCUGGGAGAAAAAGCAG | 1331 | (AGAA) | 20(C4) | VQR-SpBE3 |
| | | AGUUCUGGGAGAAAAAGCA | 1332 | (GAG) | 20(C5) | SpBE3 |
| | | AAGUUCUGGGAGAAAAAGC | 1333 | (AGAG) | 20(C6) | EQR-SpBE3 |
| | | CAAGUUCUGGGAGAAAAAG | 1334 | (CAG) | 20(C7) | SpBE3 |
| | | UCAAGUUCUGGGAGAAAAA | 1335 | (GCAG) | 20(C8) | FALSE |
| | | CUUCAAGUUCUGGGAGAAA | 1336 | (AAG) | 20(C10) | SpBE3 |
| | | AAGUUCUGGGAGAAAAAGC | 1337 | (AGAGAAC) | 20(C6) | St1BE3 |
| donor, intron 14 | CTATAGGAAATTTGgtaagtctc (SEQ ID NO: 1482) | CUUACCAAAUUUCCUAUAGC | 1338 | (AAG) | 20(C1/2) | SpBE3 |
| | | GAGACUUACCAAAUUUCCUA | 1339 | (TAG) | 20(C5/6) | SpBE3 |
| | | GACUUACCAAAUUUCCUAUA | 1340 | (GCAAGT) | 20(C7/8) | KKH-SaBE3 |
| acceptor, intron 14 | attttttctcacttagGTCTTTACTGG (SEQ ID NO: 1483) | UUCCAGUAAAGACCUAAGUG | 1341 | (AGAA) | 20(C13/14) | VQR-SpBE3 |
| | | GAUUCCAGUAAAGACCUAAG | 1342 | (TGAG) | 20(C13/14) | EQR-SpBE3 |
| | | GUAAAGACCUAAGUGAGAAA | 1343 | (AATAAT) | 20(C8/9) | KKH-SaBE3 |
| | | CCAGUAAAGACCUAAGUGAG | 1344 | (AAAAAT) | 20(C11/12) | KKH-SaBE3 |
| | | GAUUCCAGUAAAGACCUAAG | 1345 | (TGAGAAA) | 20(C15/16) | St1BE3 |
| donor, intron 15 | ATCATTCAGACTGgtaaacataaa (SEQ ID NO: 1484) | UUACCAGUCUGAAUGAUCGC | 1346 | (AGAA) | 20(C4/5) | VQR-SpBE3 |
| | | UUUACCAGUCUGAAUGAUCG | 1347 | (CAG) | 20(C5/6) | SpBE3 |
| | | UUUAUGUUUACCAGUCUGAA | 1348 | (TGAT) | 20(C11/12) | VQR-SpBE3 |
| | | AGUUUAUGUUUACCAGUCUG | 1349 | (AATGAT) | 20(C13/14) | KKH-SaBE3 |
| | | GUUUACCAGUCUGAAUGAUC | 1350 | (GCAGAAC) | 20(C6/7) | St1BE3 |
| acceptor, intron 15 | actttatatttgcttttagCTCCGAG (SEQ ID NO: 1485) | CGGAGCUAAAAGCAAAUAUA | 1351 | (AAG) | 20(C6) | SpBE3 |
| | | AGCUAAAAGCAAAUAUAAAG | 1352 | (TTTAAT) | 20(C3) | KKH-SaBE3 |
| | | CUCGGAGCUAAAAGCAAAUA | 1353 | (TAAAGT) | 20(C8) | KKH-SaBE3 |
| | | UUGAAGACUCGGAGCUAAAA | 1354 | (GCAAAT) | 20(C15) | KKH-SaBE3 |
| donor, intron 16 | ATTGGAAACCTGGTGgtatgtaacca (SEQ ID NO: 1486) | CACCAGGUUUCCAAUGACCA | 1355 | (TGAC) | 20(C1) | VQR-SpBE3 |
| | | ACAUACCACCAGGUUUCCAA | 1356 | (TGAC) | 20 (C7) | VQR-SpBE3 |
| | | UGGUUACAUACCACCAGGUU | 1357 | (TCCAAT) | 20(C12) | KKH-SaBE3 |
| acceptor, intron 16 | ccaccctgatatagGTCCTAAAC (SEQ ID NO: 1487) | CUAUAUCAGGGUGGGGAGAG | 1358 | (GGG) | 20(C1/2) | SpBE3 |
| | | CCUAUAUCAGGGUGGGGAGA | 1359 | (GGG) | 20(C2/3) | SpBE3 |
| | | ACCUAUAUCAGGGUGGGGAG | 1360 | (AGG) | 20(C3/4) | SpBE3 |
| | | GACCUAUAUCAGGGUGGGGA | 1361 | (GAG) | 20(C4/5) | SpBE3 |
| | | GGACCUAUAUCAGGGUGGGG | 1362 | (AGAG) | 20(C5/6) | EQR-SpBE3 |
| | | AGGACCUAUAUCAGGGUGGG | 1363 | (GAG) | 20(C6/7) | SpBE3 |
| | | UAGGACCUAUAUCAGGGUGG | 1364 | (GGAG) | 20(C7/8) | EQR-SpBE3 |
| | | UUAGGACCUAUAUCAGGGUG | 1365 | (GGG) | 20(C8/9) | SpBE3 |
| | | UUUAGGACCUAUAUCAGGGU | 1366 | (GGG) | 20(C9/10) | SpBE3 |
| | | GUUUAGGACCUAUAUCAGGG | 1367 | (TGG) | 20(C10/11) | SpBE3 |
| | | AGGUUUAGGACCUAUAUCAG | 1368 | (GGTG) | 20(C12/13) | VQR-SpBE3 |
| | | CCUAUAUCAGGGUGGGGAGA | 1369 | (GGGGGT) | 20(C2/3) | SaBE3 |
| | | AAUAGGUUUAGGACCUAUAU | 1370 | (CAGGGT) | 20(C15/16) | SaBE3 |
| | | CCUAUAUCAGGGUGGGGAGA | 1371 | (GGGGG) | 20(C2/3) | St3BE3 |
| | | ACCUAUAUCAGGGUGGGGAG | 1372 | (AGGGG) | 20(C3/4) | St3BE3 |
| | | UUAGGACCUAUAUCAGGGUG | 1373 | (GGAGG) | 20(C8/9) | St3BE3 |
| | | AGGACCUAUAUCAGGGUGGG | 1374 | (GAG) | 20(C6/7) | SpBE3 |
| | | GUUUAGGACCUAUAUCAGGG | 1375 | (TGGGG) | 20(C10/11) | St3BE3 |
| | | UAGGUUUAGGACCUAUAUCA | 1376 | (GGGTG) | 20(C13/14) | St3BE3 |
| donor, intron 18 | CTGTTTCACAGATGgtaagacaa (SEQ ID NO: 1488) | CCAUCUGUGAAACAGGCCUC | 1377 | (TGG) | 20(C1/2) | SpBE3 |
| | | UGUCUUACCAUCUGUGAAAC | 1378 | (AGG) | 20(C8/9) | SpBE3 |
| | | UUGUCUUACCAUCUGUGAAA | 1379 | (CAG) | 20(C9/10) | SpBE3 |
| acceptor, intron 18 | gtctttcttgtcagGTTGTGTATG (SEQ ID NO: 1489) | CAUACACAACCUGACAAGAA | 1380 | (AGAC) | 20(C10/11) | VQR-SpBE3 |
| | | CCAUACACAACCUGACAAGA | 1381 | (AAG) | 20(C11/12) | SpBE3 |
| | | AACCUCCAUACACAACCUGA | 1382 | (CAAGAAA) | 20(C16/17) | St1BE3 |
| donor, intron 19 | CTCAGCAGTGGTGCCCTGgtaaat (SEQ ID NO: 1490) | CCAGGGCACCACUGCUGAGC | 1383 | (AGG) | 20(C1/2) | SpBE3 |
| | | ACCAGGGCACCACUGCUGAG | 1384 | (CAG) | 20(C2/3) | SpBE3 |
| | | UUUACCAGGGCACCACUGCU | 1385 | (GAG) | 20(C5/6) | SpBE3 |
| | | AUUUACCAGGGCACCACUGC | 1386 | (TGAG) | 20(C6/7) | EQR-SpBE3 |
| | | ACCAGGGCACCACUGCUGAG | 1387 | (CAGGAT) | 20(C2/3) | SaBE3 |
| acceptor, intron 19 | attatttccacagGCTTTTGAAGATA (SEQ ID NO: 1491) | AGCCUGUGGAAAUAAUAUUC | 1388 | (AAG) | 20(C3/4) | SpBE3 |
| | | AAAGCCUGUGGAAAUAAUAU | 1389 | (TCAAGT) | 20(C5/6) | KKH-SaBE3 |
| | | UAUCUUCAAAAGCCUGUGGA | 1390 | (AATAAT) | 20(C13/14) | KKH-SaBE3 |

TABLE 6-continued

Alteration of Intron/Exon Junctions in NaV1.7 (SCN9A) Gene via Base Editing

| Target site* | Genome target seq. / junction | Programmable guide-RNA sequence | SEQ ID NOs | (PAM) | gRNA size (C edited) | BE type[a] |
|---|---|---|---|---|---|---|
| donor, intron 20 | CCTAATTGTTGATgtaggtactt (SEQ ID NO: 1492) | ACAUCAACAAUUAGGAAAUC | 1391 | (CAG) | 20(C2) | SpBE3 |
| | | AGUACCUACAUCAACAAUUA | 1392 | (GGAA) | 20(C9) | VQR-SpBE3 |
| | | AAGUACCUACAUCAACAAUU | 1393 | (AGG) | 20(C10) | SpBE3 |
| | | AAAGUACCUACAUCAACAAU | 1394 | (TAG) | 20(C11) | SpBE3 |
| | | AGUACCUACAUCAACAAUUA | 1395 | (GGAAAT) | 20(C9) | KKH-SaBE3 |
| donor, intron 21 | ATTTGAAGGAATGAGGgtaagaaaat (SEQ ID NO: 1493) | ACCCUCAUUCCUUCAAAUCU | 1396 | (AGAT) | 20(C2/3) | VQR-SpBE3 |
| | | UACCCUCAUUCCUUCAAAUC | 1397 | (TAG) | 20(C3/4) | SpBE3 |
| | | UUACCCUCAUUCCUUCAAAU | 1398 | (CTAGAT) | 20(C4/5) | KKH-SaBE3 |
| | | AUUUUCUUACCCUCAUUCCU | 1399 | (TCAAAT) | 20(C10/11) | KKH-SaBE3 |
| acceptor, intron 21 | cttttgaatactagGTCGTTGTG (SEQ ID NO: 1494) | CUAGUAUUCAAAAGAAAGAA | 1400 | (AAG) | 20(C1) | SpBE3 |
| | | CGACCUAGUAUUCAAAAGAA | 1401 | (AGAA) | 20(C5) | VQR-SpBE3 |
| | | ACGACCUAGUAUUCAAAAGA | 1402 | (AAG) | 20(C6) | SpBE3 |
| | | ACAACGACCUAGUAUUCAAA | 1403 | (AGAA) | 20(C9) | VQR-SpBE3 |
| | | CACAACGACCUAGUAUUCAA | 1404 | (AAG) | 20(C10) | SpBE3 |
| | | AACGACCUAGUAUUCAAAAG | 1405 | (AAAGAAA) | 20(C7) | St1BE3 |
| | | UCACAACGACCUAGUAUUCA | 1406 | (AAAGAAA) | 20(C11) | St1BE3 |
| donor, intron 22 | CTGCTTCAAGTTgtaagtgtccc (SEQ ID NO: 1495) | UUACAACUUGAAGCAGAGAU | 1407 | (AGG) | 20(C4) | SpBE3 |
| | | CUUACAACUUGAAGCAGAGA | 1408 | (TAG) | 20(C5) | SpBE3 |
| | | ACACUUACAACUUGAAGCAG | 1409 | (AGAT) | 20(C8) | VQR-SpBE3 |
| | | GACACUUACAACUUGAAGCA | 1410 | (GAG) | 20(C9) | SpBE3 |
| | | GGACACUUACAACUUGAAGC | 1411 | (AGAG) | 20(C9) | EQR-SpBE3 |
| | | GGGACACUUACAACUUGAAG | 1412 | (CAG) | 20(C11) | SpBE3 |
| | | ACUUACAACUUGAAGCAGAG | 1413 | (ATAGGT) | 20(C6) | KKH-SaBE3 |
| | | GGACACUUACAACUUGAAGC | 1414 | (AGAGAT) | 20(C10) | KKH-SaBE3 |
| acceptor, intron 22 | attaatgttattcttaaagGCAACTT (SEQ ID NO: 1496) | CCUUAAGAAUAACAUUAAU | 1415 | (AGAA) | 20(C1/2) | VQR-SpBE3 |
| | | GCCUUUAAGAAUAACAUUAA | 1416 | (TAG) | 20(C2/3) | SpBE3 |
| | | GCCUUUAAGAAUAACAUUAA | 1417 | (TAGAAT) | 20(C2/3) | SaBE3 |
| | | AAGUUGCCUUUAAGAAUAAC | 1418 | (ATTAAT) | 20(C7/8) | KKH-SaBE3 |
| | | UGCCUUUAAGAAUAACAUUA | 1419 | (ATAGAAT) | 20(C3/4) | St1BE3 |
| donor, intron 23 | ATTCTGTTAATgtaagtattgattat (SEQ ID NO: 1497) | AUAAUCAAUACUUACAUUAA | 1420 | (CAGAAT) | 20(C15) | SaBE3 |
| | | GAUAAUCAAUACUUACAUUA | 1421 | (ACAGAAT) | 20(C16) | St1BE3 |
| acceptor, intron 23 | acttttgtaaattttatagGTAGACA (SEQ ID NO: 1498) | CCUAUAAAAUUUACAAAAGU | 1422 | (TAG) | 20(C1/2) | SpBE3 |
| | | UCUACCUAUAAAAUUUACAA | 1423 | (AAG) | 20(C5/6) | SpBE3 |
| | | UGUCUACCUAUAAAAUUUAC | 1424 | (AAAAGT) | 20(C7/8) | KKH-SaBE3 |
| donor, intron 24 | ACCAACAGAAAAAGAAGtaagtatt (SEQ ID NO: 1499) | UAUCUUCUUUUUCUGUUGGU | 1425 | (TGAA) | 20(C4) | VQR-SpBE3 |
| | | UACUUAUCUUCUUUUUCUGU | 1426 | (TGG) | 20(C8) | SpBE3 |
| | | UAUCUUCUUUUUCUGUUGGU | 1427 | (TGAAAT) | 20(C4) | KKH-SaBE3 |
| | | AAUACUUAUCUUCUUUUUCU | 1428 | (GTTGGT) | 20(C10) | KKH-SaBE3 |
| donor, intron 25 | CTCGACCAGGGgtaaaaaatata (SEQ ID NO: 1500) | UUUACCCCUGGUCGAGGAAU | 1429 | (TGG) | 20(C10/11) | SpBE3 |
| | | AUUUUUUUACCCCUGGUCGA | 1430 | (GGAA) | 20(C9/10) | VQR-SpBE3 |
| | | UAUUUUUUUACCCCUGGUCG | 1431 | (AGG) | 20(C5/6) | SpBE3 |
| | | AUAUUUUUUUACCCCUGGUC | 1432 | (GAG) | 20(C10/11) | SpBE3 |
| | | UAUAUUUUUUUACCCCUGGU | 1433 | (CGAG) | 20(C11/12) | EQR-SpBE3 |
| | | UAUUUUUUUACCCCUGGUCG | 1434 | (AGGAAT) | 20(C12/13) | SaBE3 |
| acceptor, intron 25 | cttatttctttgcagAACAAAAT (SEQ ID NO: 1501) | UUUUGUUCUGCAAAGAAAUA | 1435 | (AGAA) | 20(C13/14) | VQR-SpBE3 |
| | | AUUUUGUUCUGCAAAGAAAU | 1436 | (AAG) | 20(C11/12) | SpBE3 |
| | | UUGUUCUGCAAAGAAAUAAG | 1437 | (AATAAT) | 20(C8) | KKH-SaBE3 |
| | | AUUUUGUUCUGCAAAGAAAU | 1438 | (AAGAAT) | 20(C9) | SaBE3 |
| | | CCUUGGAUUUUGUUCUGCAA | 1439 | (AGAAAT) | 20(C6) | KKH-SaBE3 |
| | | GAUUUUGUUCUGCAAAGAAA | 1440 | (TAAGAAT) | 20(C9) | St1BE3 |
| donor, intron 26 | CTCCATTGTAGgtaagaatatttt (SEQ ID NO: 1502) | AAUAUUCUUACCUACAAUGG | 1441 | (AGAT) | 20(C15) | VQR-SpBE3 |
| | | AAAUAUUCUUACCUACAAUG | 1442 | (GAG) | 20(C10) | SpBE3 |
| | | UAAAUAUUCUUACCUACAAU | 1443 | (GGAG) | 20(C11/12) | EQR-SpBE3 |
| | | AUAUUCUUACCUACAAUGGA | 1444 | (GATAAT) | 20(C12/13) | KKH-SaBE3 |
| | | UAAAUAUUCUUACCUACAAU | 1445 | (GGAGAT) | 20(C13/14) | KKH-SaBE3 |
| | | AUAAAUAUUCUUACCUACAA | 1446 | (TGGAG) | 20(C10/11) | St3BE3 |
| acceptor, intron 26 | ctccacatacagGTATGTTTCTAG (SEQ ID NO: 1503) | CUGUAUGUGGAGAAAAUAA | 1447 | (TAG) | 20(C13/14) | SpBE3 |
| | | GAAACAUACCUGUAUGUGGA | 1448 | (GGAA) | 20(C14/15) | VQR-SpBE3 |
| | | AGAAACAUACCUGUAUGUGG | 1449 | (AGG) | 20(C1) | SpBE3 |
| | | UAGAAACAUACCUGUAUGUG | 1450 | (GAG) | 20(C10) | SpBE3 |
| | | CUAGAAACAUACCUGUAUGU | 1451 | (GGAG) | 20(C11) | EQR-SpBE3 |
| | | CAUACCUGUAUGUGGAGGAA | 1452 | (AATAAT) | 20(C12) | KKH-SaBE3 |
| | | AAACAUACCUGUAUGUGGAG | 1453 | (GAAAAT) | 20(C13) | KKH-SaBE3 |

TABLE 6-continued

Alteration of Intron/Exon Junctions in NaV1.7 (SCN9A) Gene via Base Editing

| Target site* | Genome target seq. / junction | Programmable guide-RNA sequence | SEQ ID NOs | (PAM) | gRNA size (C edited) | BE type[a] |
|---|---|---|---|---|---|---|
| | | CCUGUAUGUGGAGGAAAAUA | 1454 | (ATAGAAA) | 20(C6) | St1BE3 |
| | | GCUAGAAACAUACCUGUAUG | 1455 | (TGGAG) | 20(C9) | St3BE3 |
| | | CUAGAAACAUACCUGUAUGU | 1456 | (GGAG) | 20(C2) | EQR-SpBE3 |

[a]BE types: SpBE3 = APOBEC1-SpCas9n-UGI; VQR-SpBE3 = APOBEC1-VQR-SpCas9n-UGI; EQR-SpBE3 = APOBEC1-EQR-SpCas9n-UGI; VRER-SpBE3 = APOBEC1-VRER-SpCas9n-UGI; SaBE3 = APOBEC1-SaCas9n-UGI; KKH-SaBE3 = APOBEC1-KKH-SaCas9n-UGI; St3BE3 = APOBEC1-St3Cas9n-UGI; St1BE3 = APOBEC1-St1Cas9n-UGI. *Isoform 2 is expressed preferentially in the dorsal root ganglion.

Scoring of Guide RNA Sequences for Efficient Base Editing with High Specificity and Low Off-Target Binding To achieve efficient and specific genome modifications using base editing requires judicious selection of a genomic sequence containing a target C, for which a specific complementary guide RNA sequence can be generated, and if required, a nearby PAM that matches the DNA-binding domain that is fused to the cytidine deaminase (e.g. Cas9, dCas9, Cas9n, Cpf1, NgAgo, etc.), as described in Komor et al., *Nature*, 533, 420-424 (2016), which is incorporated herein by reference. The guide RNA sequence and PAM preference define the genomic target sequence(s) of programmable DNA-binding domains (e.g. Cas9, dCas9, Cas9n, Cpf1, NgAgo, etc.). Because of the repetitive nature of some genomic sequences as well as the stochastic frequency of representation of short sequences throughout the genome it is necessary to identify guide RNAs for programming base editors that have the lowest number of potential off target sites, taking into consideration 1, 2, 3, 4, or more mismatches against all other sequences in the genome as described in Hsu et al (*Nature Biotechnology*, 2013, 31(9): 827-832), Fusi et al. (bioRxiv 021568; doi: http://dx.doi.org/10.1101/021568), Chari et al. (*Nature Methods*, 2015, 12(9): 823-6), Doench et al. (*Nature Biotechnology*, 2014, 32(12): 1262-7), Wang et al. (*Science*, 2014, 343(6166): 80-4), Moreno-Mateos et al (*Nature Methods*, 2015, 12(10):982-8), Housden et al. (*Science Signaling*, 2015, 8(393):rs9), Haeussler et al., (*Genome Biol.* 2016; 17: 148), each of which is incorporated herein by reference. The potential for the formation of bulges between the guide RNA and the target DNA may also be considered as described in Bae et al. (*Bioinformatics*, 2014, 30, 1473-5), which is incorporated herein by reference. Non-limiting examples of calculated specificity scores for selected guide RNAs are shown in Tables 7-9. Other calculated parameters that may influence DNA-binding domains programming efficiency are shown, as described in Housden et al. (*Science Signaling*, 2015, 8(393):rs9), Farboud et al. (*Genetics*, 2015, 199(4):959-71), each of which is incorporated herein by reference.

TABLE 7

Exemplary Efficiency and Specificity Scores for gRNAs for NaV1.7 (SCN9A) Protective Loss-of-Function Mutations via Premature Stop Codons

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/ GC | Off targets[d] |
|---|---|---|---|---|---|---|---|---|---|---|---|---|---|---|---|
| Q687X | EQR-SpBE3 | CAACCUCAGACAG AGAGCAA | 1504 | (TGAG) | 20 (C7) | 5.4 | 99 | 62 | 92 | 19 | 80 | 35 | 5 | - | 0-0-0-8 |
| Q687X | KKH-SaBE3 | GAUCCCAACCUCA GACAGAG | 1505 | (AGCAAT) | 20 (C12) | 6.2 | 92 | 66 | 99 | 39 | 77 | 26 | 6 | - | 0-0-0-2-13 |
| W1245X | KKH-SaBE3 | AAAUCCAGCCAAC ACCAGGC | 1506 | (ATTGGT) | 20 (C14/8) | 6.6 | 96 | 50 | 95 | 10 | 84 | 36 | 6 | + | 0-0-0-0-8 |
| Q323X | SaBE3 | CGUGUGUAGUCAG UGUCCAG | 1507 | (AGGGGT) | 20 (C11) | 8.2 | 96 | 60 | 93 | 36 | 78 | 69 | 6 | + | 0-0-0-2-5 |
| Q323X | St3BE3 | CGUGUGUAGUCAG UGUCCAG | 1508 | (AGGGG) | 20 (C11) | 8.2 | 96 | 60 | 93 | 36 | 78 | 69 | 8 | + | 0-0-0-1-16 |
| W188X | SpBE3 | GUUCCACGGGUCA CGAAGAA | 1509 | (AAG) | 20 (C5) | 5.3 | 95 | 51 | 92 | 13 | 55 | 51 | 5 | - | 0-0-0-2-45 |
| Q1494X | SpBE3 | AAAGCCAUUCCU CGACCAG | 1510 | (GGG) | 20 (C-2) | 4.9 | 88 | 68 | 96 | 40 | 84 | 64 | 4 | + | 0-0-1-9-68 |
| R835X | KKH-SaBE3 | UCAGUUCUGCGAU CAUUCAG | 1511 | (ACTGGT) | 20 (C10) | 6.8 | 98 | 60 | 85 | 51 | 71 | 58 | 6 | - | 0-0-0-0-5 |
| R841X | KKH-SaBE3 | GCUCCGAGUCUUC AAGUUGG | 1512 | (CAAAAT) | 20 (C5) | 6.6 | 98 | 51 | 84 | 63 | 66 | 58 | 6 | - | 0-0-0-1-3 |
| Q485X | St3BE3 | AAUCAAAAGAAGC UCUCCAG | 1513 | (TGGAG) | 20 (C4) | 7.5 | 94 | 61 | 87 | 24 | 85 | 50 | 7 | + | 0-0-0-1-38 |
| Q643X | KKH-SaBE3 | AAUGGACAGCUUC UGCCAGA | 1514 | (GGTGAT) | 20 (C7) | 9.9 | 95 | 60 | 85 | 65 | 67 | 54 | 9 | + | 0-0-0-2-8 |
| W730X | KKH-SaBE3 | GAAUUUUAUCCAA UAUGGAG | 1515 | (AGCAAT) | 20 (C11) | 6.6 | 94 | 60 | 84 | 20 | 88 | 21 | 6 | - | 0-0-0-1-17 |
| Q1862X | KKH-SaBE3 | UCUUCGUUCACAG AUGGAAG | 1516 | (AAAGGT) | 20 (C11) | 4.8 | 92 | 54 | 85 | 40 | 70 | 32 | 4 | - | 0-0-0-2-44 |
| Q595X | St3BE3 | GUUUGUGCCCAC AGACCCC | 1517 | (AGGAG) | 20 (C13) | 7.0 | 90 | 55 | 86 | 45 | 74 | 38 | 7 | + | 0-0-0-3-38 |
| W151X | SpBE3 | ACAUUUUGGUCC AGUCCGG | 1518 | (TGG) | 20 (C13) | 4.9 | 87 | 51 | 88 | 39 | 84 | 46 | 4 | + | 0-0-1-5-85 |

TABLE 7-continued

Exemplary Efficiency and Specificity Scores for gRNAs for NaV1.7 (SCN9A) Protective Loss-of-Function Mutations via Premature Stop Codons

| Target variants | BE type[a] | Programmable guide-RNA sequence | PAM | SEQ ID NOs | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| R523X | SpBE3 | AUAGGCGAGCACAUGAAAAG | (AGG) | 1519 | 20 (C6) | 10.6 | 78 | 61 | 96 | 75 | 78 | 58 | 10 | - | 0-0-0-5-86 |
| Q534X | KKH-SaBE3 | UACCCCCAAUCAGGUACCAC | (CCAAAT) | 1520 | 20 (C11) | 4.7 | 96 | 56 | 77 | 5 | 47 | 48 | 4 | - | 0-0-0-0-3 |
| W714X | SpBE3 | GCAAAUCUGUACCACCAAGG | (TGG) | 1521 | 20 (C13) | 5.2 | 73 | 71 | 99 | 59 | 85 | 57 | 5 | + | 0-0-0-1-14-113 |
| Q1494X | SpBE3 | AAAAGCCAAUUCCUCGACCA | (GGG) | 1522 | 20 (C-1) | 6.0 | 87 | 61 | 85 | 14 | 64 | 56 | 6 | + | 0-0-0-2-12-86 |
| W188X | SaBE3 | UCCACGGGUCACGAAGAAAA | (GTGAAT) | 1523 | 20 (C3) | 6.9 | 96 | 56 | 75 | 55 | 51 | 57 | 6 | - | 0-0-0-0-4 |
| W1245X | KKH-SaBE3 | CAGCCAACACCAGGCAUUGG | (TGAAAT) | 1524 | 20 (C9/3) | 7.0 | 91 | 50 | 80 | 9 | 60 | 48 | 7 | - | 0-0-0-1-16 |
| W188X | KKH-SaBE3 | CAGUUCCACGGGUCACGAAG | (AAAAGT) | 1525 | 20 (C7/1) | 4.3 | 99 | -1 | 71 | 22 | 66 | 65 | 4 | - | 0-0-0-0-14 |
| Q595X | SpBE3 | CACAGACCCCAGGAGCGACG | (CAG) | 1526 | 20 (C3) | 7.7 | 75 | 61 | 95 | 65 | 87 | 69 | 5 | + | 0-0-0-4-22-140 |
| Q1004X | VQR-SpBE3 | UAUGUGAAACAAACCUUACG | (TGAA) | 1527 | 20 (C10) | 7.2 | 80 | 60 | 90 | 35 | 71 | 16 | 7 | - | 0-0-0-1-10-146 |
| W1578X | KKH-SaBE3 | AAAAAUAUUCCAUCCUACAG | (TGAAGT) | 1528 | 20 (C11) | 5.2 | 86 | 62 | 83 | 13 | 81 | 35 | 5 | - | 0-0-0-4-22 |
| Q368/9X | St1BE3 | UUACCAACAGGUGAGUACCA | (AGAGAAA) | 1529 | 20 (C5) | 4.3 | 98 | 66 | 70 | 50 | 59 | 38 | 4 | - | 0-0-0-0-18 |
| Q369X | St1BE3 | UUACCAACAGGUGAGUACCA | (AGAGAAA) | 1530 | 20 (C8) | 4.3 | 98 | 66 | 70 | 50 | 59 | 38 | 4 | - | 0-0-0-0-18 |
| W188X | VQR-SpBE3 | GCCAGUUCCACGGGUCACGA | (AGAA) | 1531 | 20 (C9/3) | 2.9 | 91 | 63 | 75 | 38 | 77 | 46 | 2 | - | 0-0-0-3-33 |
| W151X | SaBE3 | GACAUUUUGGUCCAGUCCG | (GTGGGT) | 1532 | 20 (C14) | 3.6 | 99 | 49 | 66 | 27 | 69 | 52 | 3 | + | 0-0-0-0-4 |
| W1332X | KKH-SaBE3 | UCAGCCAGAAUAUAAGACAC | (ACAAGT) | 1533 | 20 (C6) | 3.6 | 92 | 67 | 73 | 51 | 78 | 51 | 3 | - | 0-0-0-2-18 |

TABLE 7-continued

Exemplary Efficiency and Specificity Scores for gRNAs for NaV1.7 (SCN9A) Protective Loss-of-Function Mutations via Premature Stop Codons

| Target variants | BE type[a] | Programmable guide-RNA sequence[a] | SEQ ID NOs | PAM | gRNA size (C edited) | Eff[b] | Hsu[c] | Fusi | Chari | Doench | Wang | M.-M. | Hous-den | Pro x/ GC | Off targets[d] |
|---|---|---|---|---|---|---|---|---|---|---|---|---|---|---|---|
| W908X | KKH-SaBE3 | CAUGUGCCACCGU GGGAGCG | 1534 | (TACAGT) | 20 (C8) | 6.3 | 92 | 59 | 72 | 5 | 58 | 56 | 6 | + | 0-0-2-8 |
| Q534X | KKH-SaBE3 | AUCAGGUACCACC CAAAUUG | 1535 | (CTAAAT) | 20 (C3) | 6.2 | 99 | 59 | 63 | 16 | 64 | 42 | 6 | - | 0-0-0-5 |
| Q1004X | SaBE3 | UUAUGUGAAACAA ACCUUAC | 1536 | (GTGAAT) | 20 (C11) | 4.8 | 96 | 44 | 65 | 13 | 28 | 37 | 4 | - | 0-0-2-21 |
| Q1907X | KKH-SaBE3 | ACCGCUUAAGGCA AAAUGUC | 1537 | (AAAAAT) | 20 (C12) | 3.9 | 98 | 49 | 62 | 3 | 35 | 44 | 3 | - | 0-0-1-3 |
| Q663X | St1BE3 | GGCACGACCAAUC AAAUACA | 1538 | (CAAGAAA) | 20 (C9) | 4.4 | 96 | 63 | 58 | 29 | 72 | 27 | 4 | - | 0-0-1-13 |
| R1381X | KKH-SaBE3 | AAUGUGCGAUGGA AAAACCU | 1539 | (GAAAGT) | 20 (C7) | 4.0 | 91 | 67 | 68 | 49 | 81 | 64 | 4 | - | 0-0-2-17 |
| R1619X | St3BE3 | CGAAUCCUACGUC UAGUCAA | 1540 | (AGGAG) | 20 (C1) | 8.5 | 99 | 60 | 54 | 32 | 49 | 54 | 8 | - | 0-0-3-0 |
| Q58X | St3BE3 | AAACAGCUGCCCU UCAUCUA | 1541 | (TGGGG) | 20 (C4) | 8.4 | 96 | 26 | 61 | 3 | 53 | 35 | 8 | - | 0-0-3-29 |
| Q708X | St3BE3 | CCAGACAAAAAUG UCCACCU | 1542 | (TGGTG) | 20 (C6) | 7.2 | 90 | 67 | 55 | 13 | 73 | 47 | 7 | + | 0-0-1-4-35 |
| Q25X | St1BE3 | CAUUGAACAACGC AUUGCUG | 1543 | (AAAGAAA) | 20 (C8) | 3.8 | 97 | 59 | 59 | 27 | 79 | 26 | 3 | - | 0-0-0-16 |
| Q1971X | St1BE3 | AGAAAUAUGAACA AGACAGA | 1544 | (ACAGAAA) | 20 (C12) | 5.8 | 64 | 53 | 92 | 13 | 80 | 17 | 5 | - | 0-0-0-20-242 |
| Q240X | St1BE3 | GGGGCUUUGAUCC AGUCAGU | 1545 | (GAAGAAG) | 20 (C13) | 5.4 | 95 | 60 | 50 | 8 | 62 | 48 | 5 | - | 0-0-1-3-11 |
| Q595X | KKH-SaBE3 | ACAGACCCCAGGA GCGAGCG | 1546 | (AGCAGT) | 20 (C2) | 4.3 | 97 | 52 | 58 | 14 | 77 | 55 | 4 | + | 0-0-0-2-12 |
| R597X | SpBE3 | GAGCGACCAGCA GUAACAU | 1547 | (CAG) | 20 (C4) | 4.1 | 91 | 64 | 58 | 48 | 76 | 63 | 4 | - | 0-0-1-0-43 |
| R1619X | SpBE3 | CGAAUCCUACGUC UAGUCAA | 1548 | (AGG) | 20 (C1) | 8.5 | 95 | 60 | 54 | 32 | 49 | 54 | 8 | - | 0-0-3-1-12 |

TABLE 7-continued

Exemplary Efficiency and Specificity Scores for gRNAs for NaV1.7 (SCN9A) Protective Loss-of-Function Mutations via Premature Stop Codons

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/ GC | Off targets[d] |
|---|---|---|---|---|---|---|---|---|---|---|---|---|---|---|---|
| R1619X | EQR-SpBE3 | GAAUCCUACGUCU AGUCAAA | 1549 | (GGAG) | 20 (C-1) | 4.1 | 78 | 47 | 76 | 19 | 45 | 27 | 4 | - | 0-0-3-9-62 |
| Q663X | SpBE3 | GCACGACCAAUCA AAUACAC | 1550 | (AAG) | 20 (C8) | 3.3 | 86 | 67 | 54 | 68 | 77 | 37 | 3 | - | 0-0-0-3-36 |
| Q1539/41X | KKH-SaBE3 | GGUCAAAGUCAAC AUAUGAC | 1551 | (TGAAGT) | 20 (C4/10) | 6.7 | 90 | 56 | 63 | 22 | 57 | 14 | 6 | - | 0-0-1-1-6 |
| Q604X | SpBE3 | GUAACAUCAGCCA AGCCAGU | 1552 | (AGG) | 20 (C12) | 3.8 | 68 | 61 | 84 | 76 | 61 | 33 | 3 | + | 0-0-2-14-105 |
| W1161X | SpBE3 | ACCUCCAUACACA ACCUGAC | 1553 | (AAG) | 20 (C6) | 7.5 | 82 | 54 | 70 | 28 | 27 | 35 | 7 | + | 0-0-2-5-85 |
| Q1378X | SpBE3 | AUGUUAGUCAAAA UGUGCGA | 1554 | (TGG) | 20 (C9) | 6.6 | 87 | 65 | 46 | 53 | 89 | 30 | 6 | + | 0-0-1-7-78 |
| M1786X | KKH-SaBE3 | CCAAACCUCAUAG AACAUCU | 1555 | (CAAAGT) | 20 (C2) | 4.4 | 91 | 61 | 52 | 20 | 51 | 34 | 4 | - | 0-0-0-4-16 |
| R277X | KKH-SaBE3 | GUUUUCGAAAAUC ACUUGAA | 1556 | (AATAAT) | 20 (C6) | 5.3 | 90 | 50 | 61 | 8 | 46 | 37 | 5 | - | 0-0-0-6-48 |
| Q604X | KKH-SaBE3 | AGCCAAGCCAGUA GGUCCCC | 1557 | (ACCAAT) | 20 (C4) | 4.8 | 97 | 54 | 25 | 7 | 48 | 38 | 4 | + | 0-0-0-0-8 |
| Q643X | St3BE3 | CAAUGGACAGCUU CUGCCAG | 1558 | (AGGTG) | 20 (C8) | 4.2 | 90 | 61 | 61 | 15 | 67 | 54 | 4 | + | 0-0-0-5-32 |
| W151X | SpBE3 | CAUUUUUGGUCCA GUCCGGU | 1559 | (GGG) | 20 (C12) | 4.8 | 94 | 56 | 46 | 36 | 38 | 48 | 4 | + | 0-0-0-1-48 |
| W188X | St1BE3 | CAGCCAGUUCCAC GGGCAC | 1560 | (GAAGAAA) | 20 (C11/5) | 6.9 | 98 | 42 | 52 | 1 | 27 | 59 | 6 | + | 0-0-1-0-11 |
| Q687X | SaBE3 | CCAACCUCAGACA GAGAGCA | 1561 | (ATGAGT) | 20 (C8) | 3.7 | 86 | 59 | 64 | 38 | 61 | 44 | 3 | - | 0-0-0-3-19 |
| Q1363X | SaBE3 | AAGUCAAGUUCCA AAUCGUU | 1562 | (CCGAAT) | 20 (C5) | 4.1 | 99 | 51 | 28 | 26 | 49 | 58 | 4 | - | 0-0-0-0-7 |
| Q1378X | VQR-SpBE3 | UGUUAGUCAAAAU GUGCGAU | 1563 | (GGAA) | 20 (C8) | 4.3 | 89 | 61 | 15 | 9 | 41 | 48 | 4 | - | 0-0-0-6-85 |

TABLE 7-continued

Exemplary Efficiency and Specificity Scores for gRNAs for NaV1.7 (SCN9A) Protective Loss-of-Function Mutations via Premature Stop Codons

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/ GC | Off targets[d] |
|---|---|---|---|---|---|---|---|---|---|---|---|---|---|---|---|
| Q1515X | KKH-SaBE3 | ACCUAGUGACAAAUCAAGCC | 1564 | (TTTGAT) | 20 (C10) | 7.6 | 93 | 47 | 57 | 11 | 60 | 1 | 7 | + | 0-0-0-1-9 |
| R1499X | KKH-SaBE3 | AAUUCCUCGACCAGGGUAA | 1565 | (AAAAAT) | 20 (C8) | 5.6 | 99 | 50 | 33 | 10 | 43 | 54 | 5 | - | 0-0-0-0-2 |
| Q643X | KKH-SaBE3 | CCCAAUGGACCAGCUUCUGCC | 1566 | (AGAGGT) | 20 (C10) | 7.9 | 88 | 36 | 60 | 11 | 35 | 34 | 7 | + | 0-0-2-1-10 |
| Q989X | KKH-SaBE3 | CAACCUCCAGAUUGCAGUGA | 1567 | (CTAGAAT) | 20 (C8) | 4.5 | 93 | 54 | 21 | 6 | 65 | 41 | 4 | - | 0-0-1-2-15 |
| Q1167X | St1BE3 | CUCAUGCUGCCAAGUUAACA | 1568 | (TAGAGT) | 20 (C11) | 6.1 | 93 | 54 | 46 | 11 | 31 | 14 | 6 | - | 0-0-0-0-19 |
| W1408X | SaBE3 | AUAUAUAUCGUCCAUCCCUU | 1569 | (AAAAGT) | 20 (C13) | 4.1 | 94 | 51 | 53 | 62 | 46 | 41 | 4 | - | 0-0-0-0-20 |
| Q58X | SpBE3 | ACAGCUGCCCUUCAUCUAUG | 1570 | (GGG) | 20 (C2) | 6.7 | 69 | 71 | 77 | 39 | 52 | 44 | 6 | - | 0-0-4-19-191 |
| R523X | SpBE3 | GGCAUAGGCGAGCACAUGAA | 1571 | (AAG) | 20 (C9) | 5.0 | 69 | 57 | 77 | 23 | 58 | 51 | 5 | - | 0-0-2-14-83 |
| R548X | SpBE3 | CUGCAAGGCGAAGCAGCAGA | 1572 | (ACAAGT) | 20 (C9) | 5.2 | 74 | 56 | 72 | 35 | 65 | 75 | 5 | - | 0-0-1-2-27 |
| Q663X | SpBE3 | CCAAUCAAAUACACAAGAAA | 1573 | (AGGCG) | 20 (C2) | 4.5 | 82 | 47 | 64 | 11 | 71 | 28 | 4 | - | 0-0-7-63 |
| W1700X | St3BE3 | CCAUCCCAGCCAGCAGAGGU | 1574 | (TGTAAT) | 20 (C7) | 7.3 | 79 | 54 | 67 | 10 | 58 | 35 | 7 | - | 0-0-2-35 |
| R523X | KKH-SaBE3 | GCAUAGGCCAGCACAUGAAA | 1575 | (AGAGGT) | 20 (C8) | 4.3 | 92 | 48 | 53 | 23 | 83 | 41 | 4 | - | 0-0-2-9 |
| R835X | SpBE3 | AGUUCUGCGAUCAUUCAGAC | 1576 | (TGG) | 20 (C8) | 7.1 | 81 | 64 | 33 | 20 | 51 | 32 | 7 | - | 0-0-1-5-42 |
| R548X | KKH-SaBE3 | GAAGCAGCAGAACAAGUCUU | 1577 | (TTTAGT) | 20 (C-1) | 4.4 | 86 | 39 | 58 | 24 | 69 | 52 | 4 | - | 0-0-4-12 |
| Q360X | SpBE3 | GCUAAUGACCCAAGAUUACU | 1578 | (GGG) | 20 (C11) | 6.0 | 71 | 55 | 72 | 25 | 36 | 15 | 6 | - | 0-0-3-8-74 |

TABLE 7-continued

Exemplary Efficiency and Specificity Scores for gRNAs for NaV1.7 (SCN9A) Protective Loss-of-Function Mutations via Premature Stop Codons

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/ GC | Off targets[d] |
|---|---|---|---|---|---|---|---|---|---|---|---|---|---|---|---|
| Q643X | KKH-SaBE3 | GGACAGCUUCUGCCAGAGGU | 1579 | (GATAAT) | 20 (C4) | 5.1 | 81 | 62 | 40 | 20 | 75 | 46 | 5 | - | 0-0-0-5-14 |
| R1381X | VQR-SpBE3 | GUGCGAUGAAAAACCUGAA | 1580 | (AGTG) | 20 (C4) | 5.5 | 59 | 58 | 84 | 4 | 59 | 48 | 5 | - | 0-0-1-21-169 |
| W1578X | KKH-SaBE3 | AAUAUUCCAUCCUACAGUGA | 1581 | (AGTAGT) | 20 (C8) | 4.1 | 83 | 60 | 44 | 13 | 74 | 43 | 4 | - | 0-0-2-3-37 |
| Q25X | VQR-SpBE3 | UUGAACAACGCAUUGCUGAA | 1582 | (AGAA) | 20 (C6) | 6.0 | 54 | 59 | 88 | 16 | 31 | 43 | 6 | - | 0-0-1-31-326 |
| Q368/9X | EQR-SpBE3 | UUACCAACAGGUGAGUACCA | 1583 | (AGAG) | 20 (C5) | 4.3 | 72 | 66 | 70 | 50 | 59 | 38 | 4 | - | 0-0-1-13-111 |
| Q369X | EQR-SpBE3 | UUACCAACAGGUGAGUACCA | 1584 | (AGAG) | 20 (C8) | 4.3 | 72 | 66 | 70 | 50 | 59 | 38 | 4 | - | 0-0-1-13-111 |
| Q941X | VQR-SpBE3 | GGAGGUCGCUGGUCAAGCUA | 1585 | (TGTG) | 20 (C14) | 3.8 | 91 | 43 | 51 | 15 | 82 | 53 | 3 | - | 0-0-0-2-44 |
| Q1167X | SpBE3 | GCCAAGUUAACAUAGAGCUA | 1586 | (GGG) | 20 (C3) | 2.9 | 76 | 65 | 66 | 60 | 74 | 29 | 2 | - | 0-0-0-13-103 |
| Q989X | SaBE3 | AACCUCCAGAUUGCAGUGAC | 1587 | (TAGAAT) | 20 (C7) | 6.3 | 92 | 49 | 11 | 3 | 24 | 44 | 6 | - | 0-0-1-1-9 |
| W1578X | KKH-SaBE3 | AUUCCAUCCUACAGUGAAGU | 1588 | (AGTAGT) | 20 (C5) | 4.4 | 89 | 51 | 15 | 15 | 37 | 35 | 4 | - | 0-0-0-1-20 |
| Q708X | SpBE3 | GACAAAAAUGUCCACCUUGG | 1589 | (TGG) | 20 (C3) | 3.9 | 47 | 55 | 92 | 17 | 67 | 56 | 3 | + | 0-0-3-25-208 |
| Q708X | KKH-SaBE3 | GUCCAGACAAAAAUGUCCAC | 1590 | (CTTGGT) | 20 (C8) | 6.0 | 76 | 54 | 63 | 28 | 71 | 34 | 6 | + | 0-0-0-12-58 |
| W724X | KKH-SaBE3 | UCCAGAUCAAGAAUUGUGU | 1591 | (GCAAAT) | 20 (C3) | 4.9 | 79 | 60 | 6 | 17 | 56 | 24 | 4 | - | 0-0-2-3-32 |
| Q805X | SaBE3 | AUGAGUAUUCCAAGUAGGC | 1592 | (TGGAAT) | 20 (C12) | 4.4 | 88 | 51 | 39 | 7 | 51 | 32 | 4 | + | 0-0-1-4-12 |
| Q485X | EQR-SpBE3 | CAAAAGAAGCUCUCCAGUGG | 1593 | (AGAG) | 20 (C1) | 6.8 | 62 | 57 | 75 | 5 | 83 | 50 | 6 | + | 0-0-2-19-210 |

TABLE 7-continued

Exemplary Efficiency and Specificity Scores for gRNAs for NaV1.7 (SCN9A) Protective Loss-of-Function Mutations via Premature Stop Codons

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| W1245X | St1BE3 | AUAACCAUAUGCUAUCCAUU | 1594 | (TTAGAAG) | 20 (C17) | 4.5 | 89 | 41 | 48 | 51 | 23 | 22 | 4 | - | 0-0-2-3-17 |
| Q1505X | KKH-SaBE3 | AUCCAAGGAUGUAUAUUUGA | 1595 | (CCTAGT) | 20 (C4) | 5.8 | 87 | 50 | 20 | 16 | 29 | 44 | 5 | - | 0-0-0-4-32 |
| Q1363X | VQR-SpBE3 | AGUCAAGUCCAAAUCGUUC | 1596 | (CGAA) | 20 (C4) | 6.2 | 88 | 48 | 19 | 32 | 44 | 29 | 6 | - | 0-0-1-4-92 |
| Q58X | SpBE3 | AAACAGCUGCCCUUCAUCUA | 1597 | (TGG) | 20 (C4) | 8.4 | 74 | 26 | 61 | 3 | 53 | 35 | 8 | - | 0-0-2-12-147 |
| Q368/9X | SpBE3 | UUUACCAACAGGUGAGUACC | 1598 | (AAG) | 20 (C6) | 4.8 | 81 | 54 | 44 | 5 | 23 | 34 | 4 | - | 0-0-1-9-88 |
| Q1401X | KKH-SaBE3 | AAGCAACUUUUAAGGGAUG | 1599 | (GACGAT) | 20 (C5) | 5.2 | 83 | 52 | 38 | 2 | 62 | 62 | 5 | + | 0-0-1-6-28 |
| Q1515X | KKH-SaBE3 | UGACAAAAUCAAGCCUUUGAU | 1600 | (ATTAGT) | 20 (C4) | 4.2 | 92 | 43 | 14 | 32 | 34 | 29 | 4 | - | 0-0-0-1-18 |
| Q643X | KKH-SaBE3 | AGCUUCUGCCAGAGGUGAUA | 1601 | (ATAGAT) | 20 (C-1) | 6.7 | 94 | 40 | 24 | 1 | 30 | 23 | 6 | - | 0-0-0-3-16 |
| Q25X | KKH-SaBE3 | UGAACAACGCCAUUGCUGAAA | 1602 | (GAAAAT) | 20 (C5) | 7.6 | 88 | 45 | 12 | 7 | 47 | 41 | 7 | - | 0-0-0-3-14 |
| Q368/9X | SpBE3 | UACCAACAGGUGAGUACCAA | 1603 | (GAG) | 20 (C4) | 4.2 | 71 | 58 | 62 | 27 | 54 | 63 | 4 | - | 0-0-1-10-123 |
| Q369X | SpBE3 | UACCAACAGGUGAGUACCAA | 1604 | (GAG) | 20 (C7) | 4.2 | 71 | 58 | 62 | 27 | 54 | 63 | 4 | - | 0-0-1-10-123 |
| W908X | VRER-SpBE3 | CGUUCAUGUGCCACCGUGGG | 1605 | (AGCG) | 20 (C12) | 4.8 | 50 | 52 | 83 | 6 | 55 | 56 | 4 | + | 1-0-0-0-1 |
| W1161X | St1BE3 | AACCUCCAUACACAACCUGA | 1606 | (CAAGAAA) | 20 (C7) | 3.4 | 49 | 61 | 84 | 25 | 77 | 29 | 3 | - | 1-0-0-0-10 |
| W1245X | St1BE3 | UAUCCAUUUAGAAGCAUUU | 1607 | (CCAGAAT) | 20 (C5) | 4.5 | 49 | 61 | 84 | 25 | 77 | 29 | 3 | - | 1-0-0-0-10 |
| W1408X | St1BE3 | CAUCCCUUAAAAGUUGCCUU | 1608 | (TAAGAAT) | 20 (C1) | 7.2 | 96 | 34 | 37 | 6 | 42 | 29 | 7 | - | 0-0-0-1-28 |

TABLE 7-continued

Exemplary Efficiency and Specificity Scores for gRNAs for NaV1.7 (SCN9A) Protective Loss-of-Function Mutations via Premature Stop Codons

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| Q1494X | SpBE3 | ACAAAAGCCAAUU CCUCGAC | 1609 | (CAG) | 20 (C2) | 5.1 | 85 | 48 | 8 | 14 | 50 | 38 | 5 | + | 0-0-0-10-75 |
| Q1494X | SpBE3 | CAAAAGCCAAUUC CUCGACC | 1610 | (AGG) | 20 (C1) | 3.5 | 81 | 52 | 25 | 6 | 71 | 37 | 3 | + | 0-0-3-12-94 |
| Q25X | SpBE3 | AUUGAACAACGCA UUGCUGA | 1611 | (AAG) | 20 (C7) | 8.3 | 61 | 58 | 70 | 11 | 65 | 26 | 8 | – | 01-1-15-82 |
| Q1462X | St1BE3 | GAUAAUUUCAACC AACAGAA | 1612 | (AAAGAAG) | 20 (C9) | 3.4 | 43 | 47 | 88 | 35 | 76 | 14 | 3 | – | 0-2-2-9-143 |
| Q240X | KKH-SaBE3 | UCCAGUCACUGAA GAAGCUU | 1613 | (TCTGAT) | 20 (C3) | 4.9 | 84 | 36 | 45 | 7 | 48 | 36 | 4 | – | 0-0-0-4-15 |
| Q408/10X | St1BE3 | AACAGAACCAGGC AAACAUU | 1614 | (GAAGAAG) | 20 (C3/9) | 4.1 | 86 | 43 | 28 | 7 | 50 | 41 | 4 | – | 0-0-1-5-65 |
| Q643X | SpBE3 | CAAUGGACAGCUU CUGCCAG | 1615 | (AGG) | 20 (C8) | 4.2 | 68 | 61 | 61 | 15 | 67 | 54 | 4 | + | 0-0-0-21-133 |
| Q708X | SpBE3 | CCAGACAAAAAUG UCCACCU | 1616 | (TGG) | 20 (C6) | 7.2 | 62 | 67 | 55 | 13 | 73 | 47 | 7 | + | 0-0-5-24-165 |
| Q708X | KKH-SaBE3 | CAGACAAAAAUGU CCACCUU | 1617 | (GGTGGT) | 20 (C5) | 4.2 | 84 | 45 | 32 | 0 | 46 | 70 | 4 | – | 0-0-0-4-20 |
| R841X | SpBE3 | UUAGCUCCGAGUC UUCAAGU | 1618 | (TGG) | 20 (C8) | 6.4 | 67 | 62 | 34 | 59 | 64 | 47 | 6 | – | 0-1-0-6-44 |
| Q1862X | SpBE3 | UUCGUUCACAGAU GGAAGAA | 1619 | (AGG) | 20 (C9) | 3.9 | 49 | 50 | 80 | 5 | 42 | 43 | 3 | – | 0-0-4-24-228 |
| W151X | SpBE3 | CCAGUCCGGUGGG UUAUUCA | 1620 | (TGG) | 20 (C2) | 7.9 | 87 | 41 | 41 | 2 | 43 | 43 | 7 | – | 0-0-1-4-35 |
| R523X | EQR-SpBE3 | GCAUAGGCGAGCA CAUGAAA | 1621 | (AGAG) | 20 (C8) | 4.3 | 74 | 48 | 53 | 23 | 83 | 41 | 4 | – | 0-0-0-8-92 |
| Q1470X | St1BE3 | GAGGUCAAGACAU CUUUAUG | 1622 | (ACAGAAG) | 20 (C6) | 4.8 | 46 | 54 | 81 | 7 | 65 | 44 | 4 | – | 1-1-0-2-25 |
| W1578X | VQR-SpBE3 | CCAUCCUACAGUG AAGUAGU | 1623 | (AGTG) | 20 (C2) | 5.2 | 78 | 48 | 35 | 25 | 37 | 44 | 5 | – | 0-0-0-17-112 |

TABLE 7-continued

Exemplary Efficiency and Specificity Scores for gRNAs for NaV1.7 (SCN9A) Protective Loss-of-Function Mutations via Premature Stop Codons

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Prox/GC Pro | Off targets[d] |
|---|---|---|---|---|---|---|---|---|---|---|---|---|---|---|---|
| Q1026X | SaBE3 | AGAUAAGACAAGCAGAAGAU | 1624 | (CTGAAT) | 20 (C9) | 4.9 | 69 | 56 | 51 | 31 | 66 | 40 | 4 | - | 0-0-1-7-40 |
| Q1077X | KKH-SaBE3 | GUGAUGGUCAAUCAUUUAUU | 1625 | (CACAAT) | 20 (C9) | 5.2 | 90 | 35 | 9 | 26 | 28 | 44 | 5 | - | 0-0-0-2-21 |
| Q58X | SpBE3 | AACAGCUGCCCUUCAUCUAU | 1626 | (GGG) | 20 (C3) | 6.2 | 74 | 49 | 3 | 7 | 24 | 25 | 6 | - | 0-0-1-10-115 |
| W151X | KKH-SaBE3 | GUCCAGUCCGGUGGGUAUAU | 1627 | (CATGGT) | 20 (C4) | 4.9 | 100 | 23 | 7 | 4 | 9 | 53 | 4 | - | 0-0-0-1-0 |
| Q323X | SpBE3 | UGUGUAGUCAGUGUCCAGAG | 1628 | (GGG) | 20 (C9) | 7.9 | 43 | 75 | 80 | 69 | 68 | 76 | 7 | + | 0-1-2-6235-1 |
| Q485X | EQR-SpBE3 | AUCAAAAGAAGCUCUCCAGU | 1629 | (GGAG) | 20 (C3) | 3.6 | 62 | 60 | 53 | 35 | 44 | 30 | 3 | - | 0-0-3-14-187 |
| Q1167X | SpBE3 | UGCCAAGUAACAUAGAGUC | 1630 | (AGG) | 20 (C4) | 6.0 | 76 | 46 | 15 | 1 | 29 | 41 | 6 | - | 0-0-2-8-89 |
| Q1515X | VQR-SpBE3 | CUAGUGACAAAUCAAGCCUU | 1631 | (TGAT) | 20 (C8) | 4.8 | 74 | 48 | 12 | 13 | 63 | 52 | 4 | - | 0-0-0-17-129 |
| Q1167X | EQR-SpBE3 | UCAUGCUGCCAAGUUAACAU | 1632 | (AGAG) | 20 (C10) | 8.6 | 64 | 53 | 57 | 43 | 69 | 27 | 8 | - | 0-0-1-27-191 |
| Q805X | SpBE3 | AUGAGUAUUCCAAGUAGGC | 1633 | (TGG) | 20 (C12) | 4.4 | 67 | 51 | 39 | 7 | 51 | 32 | 4 | + | 0-0-2-25-177 |
| Q360X | SpBE3 | GGCUAAUGACCCAAGAUUAC | 1634 | (TGG) | 20 (C12) | 6.1 | 83 | 28 | 33 | 5 | 28 | 10 | 6 | - | 0-0-1-7-57 |
| Q323X | EQR-SpBE3 | CUCCUGUGUAGUCAGUGCC | 1635 | (AGAG) | 20 (C13) | 4.4 | 75 | 40 | 5 | 1 | 34 | 46 | 4 | + | 0-0-1-10-63 |
| W730X | KKH-SaBE3 | AUCCAAUAUGGAGAGCAAUU | 1636 | (CCAGAT) | 20 (C4) | 4.1 | 64 | 39 | 51 | 5 | 19 | 44 | 4 | - | 0-0-2-11-36 |
| R214X | EQR-SpBE3 | UUCGAACUUCAGAGUAUUG | 1637 | (AGAG) | 20 (C3) | 4.7 | 42 | 49 | 72 | 2 | 33 | 28 | 4 | - | 0-2-2-14-188 |
| Q265X | VQR-SpBE3 | ACAGCUGUUCAUGGGAAACC | 1638 | (TGAA) | 20 (C2) | 8.1 | 61 | 53 | 43 | 10 | 50 | 33 | 8 | - | 0-0-4-15-185 |

TABLE 7-continued

Exemplary Efficiency and Specificity Scores for gRNAs for NaV1.7 (SCN9A) Protective Loss-of-Function Mutations via Premature Stop Codons

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Prox/GC | Off targets[d] |
|---|---|---|---|---|---|---|---|---|---|---|---|---|---|---|---|
| Q687X | EQR-SpBE3 | UCAGACAGAGAGCAAUGAGU | 1639 | (AGAG) | 20 (C5) | 4.0 | 55 | 56 | 51 | 34 | 77 | 26 | 4 | − | 0-0-3-30-285 |
| W908X | St3BE3 | AGUCGUUCAUGUGCCACCGU | 1640 | (GGGAG) | 20 (C15) | 5.7 | 48 | 63 | 24 | 22 | 54 | 63 | 5 | + | 1-0-1-3-7 |
| W363X | SpBE3 | AAGGUUUUCCCAGUAUCUU | 1641 | (GGG) | 20 (C11) | 8.2 | 64 | 46 | 28 | 10 | 55 | 46 | 8 | − | 0-0-5-17-172 |
| Q1401X | SpBE3 | UAAAGGCAACUUUUAAGGGA | 1642 | (TGG) | 20 (C7) | 7.3 | 53 | 49 | 49 | 14 | 83 | 37 | 7 | − | 0-0-3-37-245 |
| W908X | SpBE3 | UGUGCCACCGUGGGAGCGUA | 1643 | (CAG) | 20 (C6) | 5.5 | 48 | 52 | 41 | 33 | 34 | 77 | 5 | − | 1-0-0-2-49 |
| W730X | EQR-SpBE3 | UUGAAUUUUAUCCAAUAUGG | 1644 | (AGAG) | 20 (C13) | 3.0 | 41 | 52 | 54 | 6 | 68 | 29 | 3 | − | 0-1-3-33-405 |
| W808X | SpBE3 | CAAAAAUAUUCCAGCCUACU | 1645 | (TGG) | 20 (C12) | 3.8 | 61 | 34 | 31 | 1 | 22 | 34 | 3 | − | 0-1-4-18-174 |
| Q1026X | VQR-SpBE3 | GAUAAGACAAGCAGAAGAUC | 1646 | (TGAA) | 20 (C8) | 3.9 | 49 | 41 | 46 | 5 | 76 | 24 | 3 | − | 0-0-1-32-348 |
| R214X | EQR-SpBE3 | UCUUCGAACUUUCAGAGUAU | 1647 | (TGAG) | 20 (C5) | 5.4 | 56 | 38 | 19 | 11 | 33 | 30 | 5 | − | 0-1-3-10-139 |

[a]BE types: SpBE3 = APOBEC1-SpCas9n-UGI; VQR-SpBE3 = APOBEC1-VQR-SpCas9n-UGI; EQR-SpBE3 = APOBEC1-EQR-SpCas9n-UGI; VRER-SpBE3 = APOBEC1-VRER-SpCas9n-UGI; SaBE3 = APOBEC1-SaCas9n-UGI; KKH-SaBE3 = APOBEC1-KKH-SaCas9n-UGI; St3BE3 = APOBEC1-St3Cas9n-UGI; St1BE3 = APOBEC1-St1Cas9n-UGI.
[b]Efficiency score, based on Housden et al (Science Signaling, 2015, 8 (393):rs9).
[c]Specificity scores based on Hsu et al (Nature biotechnology, 2013, 31 (9):827-832), Fusi et al (bioRxiv 021568; doi: http://dx.doi.org/10.1101/021568), Chari et al (Nature Methods, 2015, 12 (9):823-6), Doench et al (Nature Biotechnology, 2014, 32 (12):1262-7), Wang et al (Science, 2014, 343 (6166): 80-4), Moreno-Mateos et al (Nature Methods, 2015, 12 (10)982-8), Housden et al (Science Signaling, 2015, 8 (393):rs9), and the "Prox/GC" column shows "+" if the proximal 6 bp to the PAM has a GC count > = 4, and GG if the guide ends with GG, based on Farboud et al (Genetics, 2015, 199 (4):959-71).
[d]Number of predicted off-target binding sites in the human genome allowing up to 0, 1, 2, 3 or 4 mismatches, respectively shown in the format 0-1-2-3-4. Algorithm used: Haeussler et al, Genome Biol. 2016; 17: 148.

TABLE 8

Exemplary Efficiency and Specificity Scores for gRNAs for NaV1.7 (SCN9A) Protective Loss-of-Function Mutations via Codon Change

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| C324Y | St1BE3 | GGACACUGACUACACACGAG | 1648 | (AAAGAAC) | 20 (C7/8) | 6.2 | 99 | 68 | 99 | 61 | 84 | 36 | 6 | + | 0-0-0-0-9 |
| P613L/S/F | KKH-SaBE3 | CCAAUGCUGCCGGUGAACGG | 1649 | (GAAAAT) | 20 (C5) | 9.2 | 100 | 63 | 97 | 70 | 88 | 71 | 9 | + | 0-0-0-0-2 |
| P591L/S/F | VRER-SpBE3 | UGUGCCCCACAGACCCCAGG | 1650 | (AGCG) | 20 (C8) | 7.8 | 97 | 64 | 96 | 18 | 84 | 69 | 7 | + | 0-0-0-1-13 |
| G785R | St1BE3 | GAUUCCAGUAAAGACCUAAG | 1651 | (TGAGAAA) | 20 (C9) | 6.3 | 94 | 59 | 99 | 24 | 78 | 42 | 6 | - | 0-0-0-1-52 |
| P683L/S/F | KKH-SaBE3 | GAUCCAACCUCAGACAGAG | 1652 | (AGCAAT) | 20 (C14) | 6.2 | 92 | 66 | 99 | 39 | 77 | 26 | 6 | - | 0-0-0-2-13 |
| C925Y | KKH-SaBE3 | UCUCCACACAGCACGCGGAA | 1653 | (CACAAT) | 20 (C2) | 4.7 | 98 | 62 | 87 | 26 | 59 | 45 | 4 | + | 0-0-0-0-11 |
| P1712/3L/S/F | KKH-SaBE3 | CCACCCGACUGUGAcCCAAA | 1654 | (AAAAGT) | 20 (C3/4/12) | 6.1 | 99 | 57 | 86 | 18 | 39 | 61 | 6 | - | 0-0-0-0-5 |
| P1606L/S/F | KKH-SaBE3 | GUGUCCCUACCCGGUUCCG | 1655 | (AGTGAT) | 20 (C13114) | 6.4 | 93 | 56 | 92 | 50 | 76 | 41 | 6 | + | 0-0-0-1-13 |
| P983L/S/F | KKH-SaBE3 | GACCCUGAUGCAAACAACCU | 1656 | (CCAGAT) | 20 (C819) | 3.5 | 96 | 58 | 82 | 9 | 74 | 24 | 3 | - | 0-0-0-2-17 |
| P591L/S/F | St3BE3 | GUUUGUGCCCCACAGACCCC | 1657 | (AGGAG) | 20 (C7-14) | 7.0 | 90 | 55 | 86 | 45 | 74 | 38 | 7 | + | 0-0-0-3-38 |
| P532L/S/F | KKH-SaBE3 | UACCCCCAAUCAGGUACCAC | 1658 | (CCAAAT) | 20 (C6-13) | 4.7 | 96 | 56 | 77 | 5 | 47 | 48 | 4 | - | 0-0-0-0-3 |
| P1606L/S/F | VQR-SpBE3 | GUGUCCCUACCCGGUUCCG | 1659 | (AGTG) | 20 (C5-12) | 6.4 | 81 | 56 | 92 | 50 | 76 | 41 | 6 | + | 0-0-1-7-62 |
| P1496/8L/S/F | SpBE3 | AAAAGCCAUUCCUCGACCA | 1660 | (GGG) | 20 (C5-12) | 6.0 | 87 | 61 | 85 | 14 | 64 | 56 | 6 | + | 0-0-2-12-86 |
| P1133/5L/S/F | St1BE3 | AUAACCCUUUGCCUGGAGAA | 1661 | (GGAGAAG) | 20 (C7-14) | 6.5 | 90 | 53 | 81 | 33 | 46 | 53 | 6 | - | 0-0-0-4-44 |
| P111L/S/F | SaBE3 | UCUCCUUUCAGUCCUCUAAG | 1662 | (AAGAAT) | 20 (C7-14) | 4.4 | 88 | 47 | 81 | 69 | 37 | 24 | 4 | - | 0-0-1-4-27 |

TABLE 8-continued

Exemplary Efficiency and Specificity Scores for gRNAs for NaV1.7 (SCN9A) Protective Loss-of-Function Mutations via Codon Change

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| P229L/S/F | KKH-SaBE3 | GUAAUCCCAGGUAAGAAGUA | 1663 | (ATTGGT) | 20 (C5-12) | 4.3 | 88 | 45 | 81 | 26 | 64 | 45 | 4 | − | 0-0-1-5-17 |
| P1791L/S/F | KKH-SaBE3 | GAAGUUGAUCCCGAUGCGA | 1664 | (CCCAGT) | 20 (C11/12) | 2.6 | 98 | 59 | 67 | 37 | 92 | 59 | 2 | − | 0-0-0-1-1 |
| C315Y | SaBE3 | AACCACAAAGGAGAGCAUCU | 1665 | (TTGAT) | 20 (C8) | 4.6 | 89 | 47 | 76 | 1 | 40 | 14 | 4 | − | 0-0-0-2-21 |
| C1154Y | SaBE3 | GAAACAGGCCUCUGGCUCAU | 1666 | (CGGAAT) | 20 (C15) | 6.6 | 90 | 55 | 74 | 17 | 46 | 66 | 6 | − | 0-0-0-4-4 |
| P1133/5L/S/F | St1BE3 | ACCUUUGCCUGGAGAAGGA | 1667 | (GAAGAAG) | 20 (C16) | 5.8 | 93 | 60 | 70 | 39 | 51 | 40 | 5 | − | 0-0-1-2-17 |
| G786R | EQR-SpBE3 | GAUUCCAGUAAAGACCUAAG | 1668 | (TGAG) | 20 (C4) | 6.3 | 63 | 59 | 99 | 24 | 78 | 42 | 6 | − | 0-0-1-28-179 |
| P1145L/S/F | SpBE3 | CUGAACCUAUGAAUUCCGAU | 1669 | (GAG) | 20 (C10) | 6.4 | 94 | 68 | 59 | 82 | 45 | 24 | 6 | − | 0-0-0-1-117 |
| P609/10L/S/F | VQR-SpBE3 | GUCCCCACCAAUGCUGCCGG | 1670 | (TGAA) | 20 (C17) | 5.5 | 87 | 57 | 75 | 12 | 87 | 60 | 5 | + | 0-0-0-10-66 |
| P609/10L/S/F | VQR-SpBE3 | AGGUCCCCACCAAUGCUGCC | 1671 | (GGTG) | 20 (C11) | 8.7 | 84 | 49 | 78 | 14 | 43 | 13 | 8 | + | 0-0-0-9-85 |
| P1093L/S/F | KKH-SaBE3 | CACCUGGGGAAUCCGAUUUG | 1672 | (GAAAAT) | 20 (C12) | 6.5 | 98 | 59 | 62 | 2 | 36 | 60 | 6 | − | 0-0-0-0-8 |
| C944Y | VRER-SpBE3 | AUAAGGCACAUAGCUUGACC | 1673 | (AGCG) | 20 (C13) | 4.8 | 100 | 60 | 48 | 12 | 66 | 21 | 4 | − | 0-0-0-1-6 |
| P337L/S/F | EQR-SpBE3 | AAACCCUGAUUAUGGCUACA | 1674 | (CGAG) | 20 (C13) | 3.9 | 77 | 63 | 82 | 7 | 29 | 28 | 3 | − | 0-0-0-13-121 |
| P594L/S/F | SpBE3 | CACAGACCCCAGGAGCGACG | 1675 | (CAG) | 20 (C5) | 7.7 | 82 | 59 | 77 | 65 | 72 | 64 | 7 | + | 0-0-2-17-142 |
| P80L/S/F | KKH-SaBE3 | GACCCCUACUAUGCAGACAA | 1676 | (AAAGGT) | 20 (C6) | 4.5 | 95 | 62 | 55 | 12 | 70 | 48 | 4 | − | 0-0-0-2-7 |
| P80L/S/F | St3BE3 | CCCCUACUAUGCAGACAAAA | 1677 | (AGGTG) | 20 (C7) | 3.5 | 92 | 37 | 65 | 27 | 24 | 42 | 3 | − | 0-0-0-4-31 |

TABLE 8-continued

Exemplary Efficiency and Specificity Scores for gRNAs for NaV1.7 (SCN9A) Protective Loss-of-Function Mutations via Codon Change

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| P60L/S/F | St3BE3 | AAACAGCUGCCCUUCAUCUA | 1678 | (TGGGG) | 20 (C11) | 8.4 | 96 | 26 | 61 | 3 | 53 | 35 | 8 | - | 0-0-3-29 |
| P1490S[d] | KKH-SaBE3 | GGGUCCAAGAAGCCACAAAA | 1679 | (GCCAAT) | 20 (C13) | 5.0 | 75 | 57 | 81 | 64 | 74 | 57 | 5 | - | 0-0-2-28 |
| P594L/S/F | KKH-SaBE3 | ACAGACCCCAGGAGCGACGC | 1680 | (AGCAGT) | 20 (C14) | 4.3 | 97 | 52 | 58 | 14 | 77 | 55 | 4 | + | 0-0-2-12 |
| C324Y | VQR-SpBE3 | CUGACACUGACUACACACG | 1681 | (AGAA) | 20 (C7) | 5.5 | 85 | 69 | 69 | 75 | 67 | 61 | 5 | + | 0-0-1-7-86 |
| G830R | St1BE3 | UGACAAUCCUUCCACAUCUG | 1682 | (CTAGAAA) | 20 (C16) | 4.1 | 96 | 58 | 58 | 15 | 54 | 36 | 4 | - | 0-0-2-13 |
| C1526Y | KKH-SaBE3 | AGACAGAUAAGAACCAUGAU | 1683 | (ACTAAT) | 20 (C5) | 4.5 | 87 | 54 | 67 | 41 | 53 | 20 | 4 | - | 0-0-3-26 |
| P850L/S/F | KKH-SaBE3 | UCCUGGCCAACAUUGAACAU | 1684 | (GCTGAT) | 20 (C6) | 5.4 | 94 | 58 | 52 | 31 | 55 | 43 | 5 | - | 0-0-2-15 |
| P67L/S/F | St3BE3 | UGGGGACAUUCCUCCCGGCA | 1685 | (TGGTG) | 20 (C9) | 4.4 | 96 | 56 | 34 | 5 | 61 | 77 | 4 | + | 0-0-0-29 |
| P148L/S/F | KKH-SaBE3 | AUAACCCACCGGACUGGACC | 1686 | (AAAAAT) | 20 (C12) | 6.5 | 99 | 52 | 46 | 17 | 52 | 28 | 6 | + | 0-0-0-4 |
| P1113/5L/S/F | St1BE3 | CAGUUGAUAACCCUUUGCCU | 1687 | (GGAGAAG) | 20 (C14) | 5.3 | 97 | 54 | 16 | 22 | 75 | 31 | 5 | - | 0-0-0-25 |
| P325L/S/F | VQR-SpBE3 | AGUGUCCAGAGGGGUACACC | 1688 | (TGTG) | 20 (C8) | 6.9 | 90 | 54 | 60 | 3 | 54 | 47 | 6 | - | 0-0-5-64 |
| P148L/S/F | SpBE3 | CCAUGAAUAACCCACCGGAC | 1689 | (TGG) | 20 (C11) | 4.4 | 98 | 52 | 46 | 18 | 56 | 43 | 4 | + | 0-0-3-24 |
| P1090L/S/F | St3BE3 | GUGACAGUGCCAAUUGCACC | 1690 | (TGGGG) | 20 (C14) | 9.0 | 98 | 50 | 51 | 16 | 59 | 10 | 9 | + | 0-0-1-20 |
| P1498/1500 L/S/F | KKH-SaBE3 | AAUCCUCGACCAGGGGUAA | 1691 | (AAAAAT) | 20 (C9110) | 5.6 | 99 | 50 | 33 | 10 | 43 | 54 | 5 | - | 0-0-0-2 |
| S1490F[d] | SpBE3 | UGGGGUCCAAGAAGCCACAA | 1692 | (AAG) | 20 (C819) | 4.2 | 63 | 64 | 85 | 16 | 74 | 64 | 4 | - | 0-0-3-18-214 |

TABLE 8-continued

Exemplary Efficiency and Specificity Scores for gRNAs for NaV1.7 (SCN9A) Protective Loss-of-Function Mutations via Codon Change

| Target variants | BE type[a] | Programmable guide-RNA sequence | PAM | SEQ ID NOs | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| P1090L/S/F | SpBE3 | UGACAGUGCCAAUUGCACCU | (GGG) | 1693 | 20 (C7/8) | 7.4 | 80 | 63 | 68 | 42 | 71 | 30 | 7 | + | 0-0-1-12-120 |
| P1018L/S/F | St3BE3 | CAAAAAGCCAAAGAUUUCCA | (GGGAG) | 1694 | 20 (C5/6) | 4.5 | 87 | 55 | 61 | 40 | 77 | 30 | 4 | − | 0-0-0-7-74 |
| G1626R | SpBE3 | UUGCUCCUUUGACUAGACGU | (AGG) | 1695 | 20 (C10/11) | 5.6 | 86 | 62 | 42 | 43 | 59 | 56 | 5 | − | 0-0-4-5-68 |
| P711/2L/S/F | KKH-SaBE3 | AAAAUGUCCACCUUGGUGU | (ACAGAT) | 1696 | 20 (C7/8) | 5.6 | 91 | 57 | 29 | 6 | 47 | 29 | 5 | + | 0-0-1-2-28 |
| C140Y | KKH-SaBE3 | AUAAAUAUGCAGUUUGUCAG | (AATAGT) | 1697 | 20 (C-1) | 9.0 | 77 | 60 | 70 | 35 | 60 | 54 | 9 | − | 0-0-0-5-34 |
| P1083L/S/F | KKH-SaBE3 | CACAAUCCCAGCCUCACAGU | (GACAGT) | 1698 | 20 (C5) | 6.0 | 85 | 62 | 50 | 18 | 62 | 45 | 6 | − | 0-0-0-2-28 |
| G1626R | SaBE3 | UUUGCUCCUUUGACUAGACG | (TAGGAT) | 1699 | 20 (C6) | 4.4 | 91 | 56 | 43 | 49 | 70 | 29 | 4 | − | 0-0-3-3-6 |
| P609/10L/S/F | KKH-SaBE3 | AGUAGGUCCCCACCAAUGCU | (GCCGGT) | 1700 | 20 (C7) | 6.1 | 97 | 50 | 39 | 21 | 61 | 48 | 6 | − | 0-0-0-1-7 |
| P1496/8L/S/F | SaBE3 | CAAAAGCCAAUUCCUCGACC | (AGGGGT) | 1701 | 20 (C12) | 3.5 | 95 | 52 | 25 | 6 | 71 | 37 | 3 | + | 0-0-0-1-7 |
| P60L/S/F | SpBE3 | ACAGCUGCCCUUCAUCUAUG | (GGG) | 1702 | 20 (C13) | 6.7 | 69 | 71 | 77 | 39 | 52 | 44 | 6 | − | 0-0-4-19-191 |
| P1133/5L/S/F | St3BE3 | ACAGUUGAUAACCCUUUGCC | (TGGAG) | 1703 | 20 (C7) | 4.7 | 94 | 52 | 29 | 12 | 62 | 11 | 4 | − | 0-0-1-3-20 |
| P609/10L/S/F | St3BE3 | UAGGCUCCACCAAUGCCUGC | (CGGTG) | 1704 | 20 (C3) | 4.6 | 94 | 52 | 15 | 12 | 61 | 46 | 4 | + | 0-0-0-5-24 |
| P1145L/S/F | EQR-SpBE3 | GCUGAACCUAUGAAUUCCGA | (TGAG) | 1705 | 20 (C4) | 3.4 | 87 | 58 | 55 | 32 | 90 | 29 | 3 | − | 0-0-1-2-79 |
| P1151L/S/F | KKH-SaBE3 | AGCCAGAGGCCUGUUUCACA | (GATGGT) | 1706 | 20 (C8) | 9.0 | 90 | 55 | 46 | 8 | 43 | 31 | 9 | − | 0-0-0-1-20 |
| P1090L/S/F | SpBE3 | GACAGUGCCAAUUGCACCUG | (GGG) | 1707 | 20 (C4/5) | 5.3 | 70 | 57 | 74 | 5 | 74 | 62 | 5 | + | 0-0-1-20-184 |

TABLE 8-continued

Exemplary Efficiency and Specificity Scores for gRNAs for NaV1.7 (SCN9A) Protective Loss-of-Function Mutations via Codon Change

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| P1133/5L/S/F | St3BE3 | GAUAACCCUUUGCCUGGAGA | 1708 | (AGGAG) | 20 (C5) | 3.7 | 93 | 51 | 42 | 12 | 82 | 33 | 3 | - | 0-0-0-3-35 |
| P1955/6L/S/F | KKH-SaBE3 | CCACCUCCACCUUCAUAU | 1709 | (GAUAGU) | 20 (C8) | 8.1 | 92 | 52 | 42 | 63 | 37 | 38 | 8 | - | 0-0-0-1-12 |
| P1496L/S/F | St3BE3 | CAAAAGCCAAUUCCUCGACC | 1710 | (AGGGG) | 20 (C9) | 3.5 | 92 | 52 | 25 | 6 | 71 | 37 | 3 | + | 0-0-0-1-22 |
| P1360L/S/F | KKH-SaBE3 | GGUUUCCUGCAAGUCAAGUU | 1711 | (CCAAAU) | 20 (C13) | 10.8 | 90 | 47 | 53 | 24 | 57 | 48 | 10 | - | 0-0-0-3-9 |
| C1154Y | SpBE3 | GAAACAGGCCCUCUGGCUCAU | 1712 | (CGG) | 20 (C10) | 6.6 | 68 | 55 | 74 | 17 | 46 | 66 | 6 | - | 0-0-1-22-132 |
| P1722L/S/F | St3BE3 | CAUCCUGGAAGUUCAGUUGA | 1713 | (AGGAG) | 20 (C14) | 4.4 | 89 | 53 | 42 | 5 | 39 | 35 | 4 | - | 0-0-1-5-40 |
| C1370Y | SpBE3 | GCAAAACAUUCGGAACGAUU | 1714 | (TGG) | 20 (C2) | 3.9 | 95 | 37 | 47 | 14 | 64 | 26 | 3 | - | 0-0-1-2-35 |
| P1773L/S/F | KKH-SaBE3 | CCUCUGAGUGAGGAUGACUU | 1715 | (TGAGAT) | 20 (C3) | 5.0 | 92 | 50 | 25 | 16 | 40 | 42 | 5 | - | 0-0-1-3-12 |
| P60L/S/F | VQR-SpBE3 | CAGCUGCCCCUUCAUCUAUGG | 1716 | (GGAC) | 20 (C4) | 6.0 | 76 | 65 | 47 | 21 | 68 | 67 | 6 | - | 0-0-0-13-167 |
| G1736R | KKH-SaBE3 | UAUUCCAACAGAUGGGUUAC | 1717 | (CACAGT) | 20 (C10/11) | 5.5 | 95 | 42 | 46 | 1 | 19 | 39 | 5 | - | 0-0-0-1-10 |
| P1093L/S/F | VQR-SpBE3 | GCACCUGGGGAAUCCGAUUU | 1718 | (GGAA) | 20 (C6/7) | 5.4 | 93 | 36 | 48 | 6 | 36 | 59 | 5 | - | 0-0-1-2-54 |
| P1133/5L/S/F | EQR-SpBE3 | AUAACCCUUUGCCUGGAGAA | 1719 | (GGAG) | 20 (C12/13) | 6.5 | 59 | 53 | 81 | 33 | 46 | 53 | 6 | - | 0-0-2-22-182 |
| P187L/S/F | SaBE3 | UUCGUGACCCGUGGAACUGG | 1720 | (CTGGAT) | 20 (C12-14) | 7.2 | 87 | 53 | 51 | 10 | 73 | 58 | 7 | - | 0-0-2-2-5 |
| C1690Y | KKH-SaBE3 | AGGCAAAUCAUACUGUUGCC | 1721 | (AAAGGT) | 20 (C10/11) | 6.3 | 91 | 49 | 43 | 19 | 36 | 33 | 6 | + | 0-0-1-1-19 |
| P229L/S/F | St3BE3 | AAUCCCAGGUAAGAAGUAAU | 1722 | (TGGTG) | 20 (C1-5) | 7.1 | 83 | 38 | 57 | 9 | 38 | 54 | 7 | - | 0-0-1-4-47 |

TABLE 8-continued

Exemplary Efficiency and Specificity Scores for gRNAs for NaV1.7 (SCN9A) Protective Loss-of-Function Mutations via Codon Change

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| C330Y | VQR-SpBE3 | UCACACAGGUGUAC cccucu | 1723 | (GGAC) | 20 (C213) | 5.8 | 85 | 55 | 38 | 2 | 27 | 51 | 5 | + | 0-0-0-9-101 |
| G1577R | KKH-SaBE3 | AUUCCAUCCUACAG UGAAGU | 1724 | (AGTAGT) | 20 (C-1) | 4.4 | 89 | 51 | 15 | 15 | 37 | 35 | 4 | - | 0-0-0-1-20 |
| C324Y | St1BE3 | CUCUGGACACUGAC UACACA | 1725 | (CGAGAAA) | 20 (C1) | 5.8 | 87 | 52 | 23 | 34 | 45 | 21 | 5 | - | 0-0-1-3-46 |
| G1626R | VQR-SpBE3 | UGCUCCUUUGACUA GACGUA | 1726 | (GGAT) | 20 (C13) | 4.8 | 89 | 49 | 48 | 50 | 26 | 51 | 4 | - | 0-0-3-5-66 |
| C275Y | KKH-SaBE3 | AUUUCGAAAACAUU UAUGCU | 1727 | (TCAGGT) | 20 (C15) | 5.8 | 83 | 45 | 55 | 7 | 52 | 14 | 5 | - | 0-0-0-3-48 |
| P1093L/S/F | SpBE3 | UGCACCUGGGGAAU CCGAUU | 1728 | (TGG) | 20 (C16) | 7.0 | 94 | 34 | 44 | 0 | 29 | 37 | 7 | - | 0-0-0-4-48 |
| P683L/S/F | EQR-SpBE3 | AUGAUCCCAACCUC AGACAG | 1729 | (AGAG) | 20 (C1) | 3.8 | 66 | 61 | 71 | 36 | 80 | 57 | 3 | - | 0-0-1-18-162 |
| P1018L/S/F | KKH-SaBE3 | AAAAAGCCAAAGAU UUCCAG | 1730 | (GGAGAT) | 20 (C18) | 5.8 | 49 | 57 | 88 | 27 | 91 | 43 | 5 | - | 0-0-1-12-27 |
| P1090L/S/F | SpBE3 | GUGACAGUGCCAAU UGCACC | 1731 | (TGG) | 20 (C2) | 9.0 | 86 | 50 | 51 | 16 | 59 | 10 | 9 | + | 0-0-2-8-82 |
| P609/10L/S/F | SpBE3 | CCACCAAUGCUGCC GGUGAA | 1732 | (CGG) | 20 (C16) | 7.3 | 87 | 50 | 49 | 19 | 22 | 47 | 7 | - | 0-0-1-7-85 |
| P1319L/S/F | VQR-SpBE3 | GCAAUCCUUCCAU CAUGAA | 1733 | (TGTG) | 20 (C16) | 5.9 | 63 | 55 | 73 | 16 | 64 | 28 | 5 | - | 0-0-2-18-223 |
| P536L/S/F | SpBE3 | CAGUACCACUCAG CAUUCG | 1734 | (TGG) | 20 (C3/4) | 7.0 | 81 | 43 | 55 | 9 | 45 | 39 | 7 | - | 0-0-1-12-123 |
| P1297L/S/F | KKH-SaBE3 | AAGACCUCUAAGAG CCUUAU | 1735 | (CTAGAT) | 20 (C1112) | 5.1 | 98 | 38 | 8 | 6 | 40 | 54 | 5 | - | 0-0-0-1-5 |
| P60L/S/F | SpBE3 | AAACAGCUGCCCUU CAUCUA | 1736 | (TGG) | 20 (C314) | 8.4 | 74 | 26 | 61 | 3 | 53 | 35 | 8 | - | 0-0-2-12-147 |
| P35L/S/F | St1BE3 | UCAAAGGAACCCAA AGAAGA | 1737 | (AAAGAAA) | 20 (C11/12) | 5.0 | 43 | 46 | 91 | 11 | 72 | 29 | 5 | - | 0-1-0-21-224 |
| P67/8L/S/F | SpBE3 | UGGGGACAUUCCUC CCGGCA | 1738 | (TGG) | 20 (C7/8) | 4.4 | 78 | 56 | 34 | 5 | 61 | 77 | 4 | + | 0-0-0-8-149 |

TABLE 8-continued

Exemplary Efficiency and Specificity Scores for gRNAs for NaV1.7 (SCN9A) Protective Loss-of-Function Mutations via Codon Change

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| P646L/S/F | KKH-SaBE3 | AGCUUCUGCCAGAGGUGAUA | 1739 | (ATAGAT) | 20 (C5/6) | 6.7 | 94 | 40 | 24 | 1 | 30 | 23 | 6 | - | 0-0-0-3-16 |
| P1829L/S/F | St3BE3 | AUGGAUCUGCCCAUGGUUAG | 1740 | (TGGTG) | 20 (C4/5) | 10.0 | 68 | 49 | 65 | 10 | 39 | 59 | 10 | - | 0-2-3-2-39 |
| C330Y | SpBE3 | UUCACACAGUGUACCCCUC | 1741 | (TGG) | 20 (C3/4) | 5.0 | 87 | 42 | 46 | 4 | 29 | 50 | 5 | + | 0-0-0-8-88 |
| G1577R | SpBE3 | UCCAUCCUACAGUGAAGUAG | 1742 | (TAG) | 20 (C2/3) | 6.5 | 72 | 61 | 40 | 24 | 62 | 53 | 6 | - | 0-0-4-11-122 |
| P1496/8L/S/F | SpBE3 | CAAAAGCCAAUUCCUCGACC | 1743 | (AGG) | 20 (C1/2) | 3.5 | 81 | 52 | 25 | 6 | 71 | 37 | 3 | + | 0-0-3-12-94 |
| C1328Y | KKH-SaBE3 | AGACACACAAGUAGCACAUU | 1744 | (CATGAT) | 20 (C13/14) | 5.1 | 90 | 43 | 22 | 5 | 29 | 29 | 5 | - | 0-0-0-1-20 |
| P1496L/S/F | SpBE3 | ACAAAAGCCAAUUCCUCGAC | 1745 | (CAG) | 20 (C415) | 5.1 | 85 | 48 | 8 | 14 | 50 | 38 | 5 | + | 0-0-0-10-75 |
| G1339R | St1BE3 | CCCAUGAUGCUGAAUAUCAG | 1746 | (CCAGAAT) | 20 (C7) | 6.9 | 62 | 64 | 70 | 41 | 63 | 39 | 6 | - | 0-2-3-3-15 |
| P1717L/S/F | SpBE3 | GACCCAAAAAAAGUUCAUCC | 1747 | (TGG) | 20 (C13114) | 5.9 | 63 | 56 | 69 | 6 | 73 | 0 | 5 | - | 0-0-3-18-120 |
| P591L/S/F | EQR-SpBE3 | UUUGUGCCCCACAGACCCCA | 1748 | (GGAG) | 20 (C12/13) | 6.8 | 56 | 55 | 76 | 70 | 75 | 54 | 6 | + | 0-0-1-32-223 |
| G1626R | SpBE3 | UUUGCUCCUUUGACUAGACG | 1749 | (TAG) | 20 (C13/14) | 4.4 | 76 | 56 | 43 | 44 | 70 | 29 | 4 | - | 0-0-2-24-72 |
| P114L/S/F | SpBE3 | CCUCUAAGAAGAAUAUCUAU | 1750 | (TAAGAT) | 20 (C3) | 6.1 | 93 | 38 | 30 | 16 | 37 | 0 | 6 | - | 0-0-0-2-21 |
| P800L/S/F | KKH-SaBE3 | AUGGAUCCAUAUGAGUAUUU | 1751 | (CCAAGT) | 20 (C12) | 5.8 | 90 | 41 | 3 | 3 | 22 | 62 | 5 | - | 0-0-0-2-18 |
| P1285L/S/F | SpBE3 | UUGGCCCCAUUAAAUCCCUU | 1752 | (CGG) | 20 (C13) | 4.5 | 77 | 52 | 46 | 51 | 45 | 39 | 4 | - | 0-0-1-10-123 |
| G1626R | SpBE3 | CUUUGACUAGACGUAGGAUU | 1753 | (CGG) | 20 (C5) | 7.9 | 81 | 48 | 9 | 41 | 28 | 52 | 7 | - | 0-0-3-2-53 |

TABLE 8-continued

Exemplary Efficiency and Specificity Scores for gRNAs for NaV1.7 (SCN9A) Protective Loss-of-Function Mutations via Codon Change

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| P111L/S/F | St1BE3 | UUCUCCUUUCAGUC CUCUAA | 1754 | (GAAGAAT) | 20 (C14) | 6.5 | 88 | 41 | 6 | 6 | 17 | 26 | 6 | - | 0-0-0-8-47 |
| C944Y | SpBE3 | AAUAAGGCACAUAG CUUGAC | 1755 | (CAG) | 20 (C13/14) | 7.7 | 75 | 53 | 19 | 12 | 34 | 35 | 7 | - | 0-0-3-7-76 |
| C753Y | KKH-SaBE3 | AACUAUGCAAAUGG UAAUUG | 1756 | (CAAGAT) | 20 (C12/13) | 5.0 | 79 | 48 | 36 | 2 | 54 | 34 | 5 | - | 0-0-2-3-48 |
| P610L/S/F | SpBE3 | CACCAAUGCUGCCG GUGAAC | 1757 | (GGG) | 20 (C11/12) | 4.0 | 90 | 37 | 17 | 4 | 19 | 40 | 4 | - | 0-0-0-6-66 |
| P1829L/S/F | SpBE3 | AUGGAUCUGCCCAU GGUUAG | 1758 | (TGG) | 20 (C10/11) | 10.0 | 60 | 49 | 65 | 10 | 39 | 59 | 10 | - | 0-2-4-14-116 |
| P1090/3L/S/F | KKH-SaBE3 | UGCCAAUGCACCU GGGGAA | 1759 | (TCCGAT) | 20 (C7/8) | 8.9 | 82 | 43 | 21 | 4 | 44 | 31 | 8 | + | 0-0-1-4-13 |
| P711/2L/S/F | VQR-SpBE3 | AAUGUCCACCUUGG UGGUAC | 1760 | (AGAT) | 20 (C112) | 8.2 | 82 | 43 | 7 | 5 | 36 | 56 | 8 | - | 0-0-0-12-94 |
| P5/6/7L/S/F | EQR-SpBE3 | GUUGCCUCCCCCAG GACCUC | 1761 | (AGAG) | 20 (C1/2) | 7.0 | 57 | 34 | 67 | 2 | 53 | 31 | 7 | + | 0-0-1-23-184 |
| P1829L/S/F | KKH-SaBE3 | CCAUGGAUCUGCCC AUGGUU | 1762 | (AGTGGT) | 20 (C9/10) | 4.3 | 94 | 30 | 17 | 8 | 44 | 50 | 4 | - | 0-0-1-3-8 |
| C325Y | EQR-SpBE3 | CUCUGGACACUGAC UACACA | 1763 | (CGAG) | 20 (C2/3) | 5.8 | 71 | 52 | 23 | 34 | 45 | 21 | 5 | - | 0-0-2-14141 |
| P60L/S/F | SpBE3 | AACAGCUGCCCUUC AUCUAU | 1764 | (GGG) | 20 (C1/2) | 6.2 | 74 | 49 | 3 | 7 | 24 | 25 | 6 | - | 0-0-1-10-115 |
| P111L/S/F | St1BE3 | GCUUUCUCCUUUCA GUCCUC | 1765 | (TAAGAAG) | 20 (C2/3) | 4.9 | 93 | 28 | 14 | 11 | 38 | 34 | 4 | + | 00 5-29 |
| P187L/S/F | VQR-SpBE3 | CGUGACCCGUGGAA CUGGCU | 1766 | (GGAT) | 20 (C8-12) | 6.0 | 77 | 43 | 11 | 11 | 48 | 57 | 6 | + | 0-0-3-9-35 |
| P744L/S/F | KKH-SaBE3 | AUGGAUCCUUUUGU AGAUCU | 1767 | (TGCAAT) | 20 (C14/15) | 6.6 | 91 | 28 | 0 | 0 | 38 | 59 | 6 | - | 0-0-0-2-22 |
| P1722L/S/F | EQR-SpBE3 | AUCCUGGAAGUUCA GUUGAA | 1768 | (GGAG) | 20 (C9/10) | 4.7 | 63 | 55 | 53 | 16 | 23 | 44 | 4 | - | 0-0-3-13-230 |

TABLE 8-continued

Exemplary Efficiency and Specificity Scores for gRNAs for NaV1.7 (SCN9A) Protective Loss-of-Function Mutations via Codon Change

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| G236R | SpBE3 | AAGCCCUACAAUU GUCUUC | 1769 | (AGG) | 20 (C16/17) | 9.1 | 75 | 43 | 42 | 20 | 26 | 35 | 9 | − | 0-0-2-9-84 |
| P1829L/S/F | VQR-SpBE3 | UGGAUCUGCCCAUG GUUAGU | 1770 | (GGTG) | 20 (C13/14) | 6.3 | 77 | 41 | 34 | 9 | 23 | 37 | 6 | − | 0-0-2-11-102 |
| G1662R | VRER-SpBE3 | AAGUUGGACAUUCC AAAGAU | 1771 | (GGCG) | 20 (C12/13) | 4.2 | 64 | 54 | 19 | 8 | 66 | 59 | 4 | − | 0-1-1-1-3 |
| P1133/5L/S/F | SpBE3 | GAUAACCCUUUGCC UGGAGA | 1772 | (AGG) | 20 (C10/11) | 3.7 | 66 | 51 | 42 | 12 | 82 | 33 | 3 | − | 0-0-1-15-115 |
| P1151L/S/F | KKH-SaBE3 | AUGAGCCAGAGGCC UGUUUC | 1773 | (ACAGAT) | 20 (C9l10) | 6.0 | 93 | 24 | 18 | 1 | 16 | 51 | 6 | − | 0-0-0-1-18 |
| P1722L/S/F | SpBE3 | CAUCCUGGAAGUUC AGUUGA | 1774 | (AGG) | 20 (C7/8) | 4.4 | 63 | 53 | 42 | 5 | 39 | 35 | 4 | − | 0-0-2-21-161 |
| C134Y | VQR-SpBE3 | AGUGCACAUGAUGA GCAUGC | 1775 | (TGAA) | 20 (C2/3) | 6.3 | 55 | 60 | 55 | 16 | 61 | 29 | 6 | + | 0-1-2-12-131 |
| C1562Y | SpBE3 | GCACACAUUCCA GUGAAA | 1776 | (AGG) | 20 (C12/13) | 6.0 | 45 | 47 | 69 | 21 | 61 | 24 | 6 | − | 0-1-2-23-147 |
| C1159Y | SpBE3 | CCAUACACAACCUG ACAAGA | 1777 | (AAG) | 20 (C4/5) | 2.7 | 43 | 57 | 70 | 14 | 67 | 24 | 2 | − | 1-0-1-8-88 |
| P906L/S/F | VQR-SpBE3 | UACGCUCCCACGGU GGCACA | 1778 | (TGAA) | 20 (C10/11) | 6.6 | 47 | 53 | 59 | 10 | 44 | 46 | 6 | + | 1-0-0-2-33 |
| C315Y | SpBE3 | ACCACAAAGGAGAG CAUCUU | 1779 | (TGG) | 20 (C13/14) | 5.8 | 60 | 30 | 44 | 2 | 34 | 40 | 5 | − | 0-0-3-19-168 |
| C1715Y | St1BE3 | ACAGUCGGUGGGCU UACUGU | 1780 | (TAAGAAT) | 20 (C16/17) | 7.4 | 50 | 53 | 33 | 2 | 70 | 36 | 7 | − | 1-0-0-1-3 |
| P850L/S/F | VQR-SpBE3 | CUGGCCAACAUUGA ACAUGC | 1781 | (TGAT) | 200 ( ) | 5.2 | 41 | 58 | 26 | 4 | 56 | 31 | 5 | − | 0-1-4-23-152 |

TABLE 8-continued

Exemplary Efficiency and Specificity Scores for gRNAs for NaV1.7 (SCN9A) Protective Loss-of-Function Mutations via Codon Change

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/ GC | Off targets[d] |
|---|---|---|---|---|---|---|---|---|---|---|---|---|---|---|---|
| P1829L/S/F | SaBE3 | CUGCCCAUGGUUAGUGGUGA | 1782 | (CCGGAT) | 20 (C10-14) | 5.5 | 47 | 46 | 6 | 5 | 41 | 71 | 5 | - | 0-2-1-1-13 |
| C275Y | SpBE3 | UUCGAAAACAUUUAUGCUUC | 1783 | (AGG) | 20 (C11/12) | 4.3 | 54 | 25 | 2 | 0 | 13 | 17 | 4 | - | 0-0-5-15-166 |

[a]BE types: SpBE3 = APOBEC1-SpCas9n-UGI; VQR-SpBE3 = APOBEC1-VQR-SpCas9n-UGI; EQR-SpBE3 = APOBEC1-EQR-SpCas9n-UGI; VRER-SpBE3 = APOBEC1-VRER-SpCas9n-UGI; SaBE3 = APOBEC1-SaCas9n-UGI; KKH-SaBE3 = APOBEC1-KKH-SaCas9n-UGI; St3BE3 = APOBEC1-St3Cas9n-UGI; St1BE3 = APOBEC1-St1Cas9n-UGI.
[b]Efficiency score, based on Housden et al (Science Signaling, 2015, 8 (393):rs9).
[c]Specificity scores based on Hsu et al (Nature biotechnology, 2013, 31 (9):827-832), Fusi et al (bioRxiv 021568; doi: http://dx.doi.org/10.1101/021568), Chari et al (Nature Methods, 2015, 12 (9):823-6), Doench et al (Nature Biotechnology, 2014, 32 (12):1262-7), Wang et al (Science, 2014, 343 (6166):80-4), Moreno-Mateos et al (Nature Methods, 2015, 12 (10):982-8), Housden et al (Science Signaling, 2015, 8 (393):rs9), and the "Prox/GC" column shows "+" if the proximal 6 bp to the PAM has a GC count > = 4, and GG if the guide ends with GG, based on Farboud et al (Genetics, 2015, 199 (4):959-71).
[d]Number of predicted off-target binding sites in the human genome allowing up to 0, 1, 2, 3 or 4 mismatches, respectively shown in the format 0-1-2-3-4. Algorithm used: Haeussler et al, Genome Biol. 2016; 17:148.
[e]Phospho-serine site S1490.

TABLE 9

Exemplary Efficiency and Specificity Scores for gRNAs for Alteration of Intron/Exon Junctions in NaV1.7 (SNA9A) Gene via Base Editing

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Prox/GC | Off targets[d] |
|---|---|---|---|---|---|---|---|---|---|---|---|---|---|---|---|
| acceptor, intron 9 | KKH-SaBE3 | GCAGCACGCAGCGU CUAGGG | 1784 | (AAAAAT) | 20 (C15) | 6.6 | 98 | 60 | 99 | 52 | 91 | 67 | 6 | + | 0-0-0-0-8 |
| acceptor, intron 9 | KKH-SaBE3 | GCAGCACGCAGCGU CUAGGG | 1785 | (AAT) | 20 (C15) | 6.6 | 98 | 60 | 99 | 52 | 91 | 67 | 6 | + | 0-0-0-0-8 |
| acceptor, intron 16 | St3BE3 | GUUUAGGACCUAUA UCAGGG | 1786 | (TGGGG) | 20 (C10/11) | 5.6 | 97 | 71 | 99 | 40 | 89 | 30 | 5 | + | 0-0-0-0-18 |
| acceptor, intron 14 | St1BE3 | GAUUCCAGUAAAGA CCUAAG | 1787 | (TGAGAAA) | 20 (C15/16) | 6.3 | 94 | 59 | 99 | 24 | 78 | 42 | 6 | - | 0-0-0-1-52 |
| donor, intron 22 | KKH-SaBE3 | ACUUACAACUUGAA GCAGAG | 1788 | (ATAGGT) | 20 (C6) | 4.8 | 91 | 67 | 97 | 22 | 57 | 34 | 4 | + | 0-0-0-2-20 |
| acceptor, intron 26 | St3BE3 | GCUAGAAACAUACC UGUAUG | 1789 | (TGGAG) | 20 (C14) | 4.6 | 96 | 58 | 90 | 19 | 53 | 44 | 4 | - | 0-0-0-1-19 |
| donor, intron 19 | SaBE3 | ACCAGGGCACCACU GCUGAG | 1790 | (CAGGAT) | 20 (C2/3) | 8.4 | 86 | 70 | 97 | 37 | 55 | 49 | 8 | + | 0-0-2-7-16 |
| donor, intron 19 | St1BE3 | AACUCCAUACACA ACCUGA | 1791 | (CAAGAAA) | 20 (C16/17) | 3.4 | 98 | 61 | 84 | 25 | 77 | 29 | 3 | - | 0-0-0-0-10 |
| donor, intron 5 | SpBE3 | GUUUAGGACCUAUA UCAGGG | 1792 | (TGG) | 20 (C10/11) | 5.6 | 84 | 71 | 97 | 40 | 89 | 30 | 5 | + | 0-0-1-6-63 |
| donor, intron 5 | St1BE3 | AACGACCUAGUAUU CAAAAG | 1793 | (AAAGAAA) | 20 (C7) | 6.0 | 92 | 53 | 89 | 23 | 59 | 39 | 6 | - | 0-0-0-2-28 |
| donor, intron 5 | KKH-SaBE3 | UUACGCCAAAAACAA UGACGA | 1794 | (CAAAAT) | 20 (C4) | 4.0 | 99 | 71 | 79 | 60 | 78 | 39 | 4 | - | 0-0-0-0-10 |
| acceptor, intron 14 | KKH-SaBE3 | CCAGUAAAGACCUA AGUGAG | 1795 | (AAAAAT) | 20 (C11/12) | 5.0 | 95 | 64 | 80 | 40 | 62 | 47 | 5 | - | 0-0-0-1-20 |
| acceptor, intron 8 | SpBE3 | GACACUGACUACAC ACGAGA | 1796 | (AAG) | 20 (C9) | 4.0 | 87 | 60 | 87 | 17 | 87 | 30 | 4 | - | 0-0-1-5-60 |
| acceptor, intron 6 | St1BE3 | UGUCUUCAGGCCUG AAAAUG | 1797 | (GGAGAAA) | 20 (C11/12) | 4.8 | 89 | 54 | 83 | 1 | 43 | 53 | 4 | - | 0-0-1-434 |
| donor, intron 15 | VQR-SpBE3 | UUACCAGUCUGAAU GAUCGC | 1798 | (AGAA) | 20 (C4/5) | 6.6 | 92 | 62 | 80 | 68 | 64 | 12 | 6 | + | 0-0-0-4-58 |

TABLE 9-continued

Exemplary Efficiency and Specificity Scores for gRNAs for Alteration of Intron/Exon Junctions in NaV1.7 (SN9A) Gene via Base Editing

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Prox/GC | Off targets[d] |
|---|---|---|---|---|---|---|---|---|---|---|---|---|---|---|---|
| donor, intron 12b | SpBE3 | CGUCCUUACGCUGU CAUCAG | 1799 | (AAG) | 20 (C9) | 7.5 | 84 | 58 | 85 | 20 | 53 | 57 | 7 | - | 0-0-0-449 |
| donor, intron 4 | KKH-SaBE3 | ACUCGACAUUUUUG GUCCAG | 1800 | (TCCGGT) | 20 (C2) | 5.4 | 99 | 55 | 67 | 8 | 51 | 52 | 5 | + | 0-0-0-2-3 |
| acceptor, intron 14 | VQR-SpBE3 | UUCCAGUAAAGACC UAAGUG | 1801 | (AGAA) | 20 (C13/14) | 2.7 | 74 | 68 | 91 | 13 | 62 | 33 | 2 | - | 0-0-1-9-206 |
| acceptor, intron 14 | EQR-SpBE3 | GAUUCCAGUAAAGA CCUAAG | 1802 | (TGAG) | 20 (C13/14) | 6.3 | 63 | 59 | 99 | 24 | 78 | 42 | 6 | - | 0-0-1-28-179 |
| acceptor, intron 12 | KKH-SaBE3 | GGUCGUGCCCUAAA AAAAAA | 1803 | (ATCAAT) | 20 (C9/10) | 6.1 | 85 | 32 | 76 | 59 | 69 | 25 | 6 | - | 0-0-0-1-14 |
| acceptor, intron 16 | St3BE3 | UAGGUUUAGGACCU AUAUCA | 1804 | (GGGTG) | 20 (C13/14) | 6.1 | 97 | 64 | 28 | 11 | 64 | 52 | 6 | - | 0-0-0-0-13 |
| acceptor, intron 16 | EQR-SpBE3 | GGACCUAUAUCAGG GuGGGG | 1805 | (AGAG) | 20 (C5/6) | 4.7 | 60 | 46 | 98 | 25 | 87 | 43 | 4 | + | 0-0-3-15-150 |
| acceptor, intron 16 | VQR-SpBE3 | AGGUUUAGGACCUA UAUCAG | 1806 | (GGTG) | 20 (C12/13) | 5.1 | 79 | 71 | 79 | 5 | 75 | 50 | 5 | - | 0-0-1-5-100 |
| acceptor, intron 8 | VQR-SpBE3 | ACACUGACUACACA cGAGAA | 1807 | (AGAA) | 20 (C8) | 3.4 | 82 | 59 | 76 | 25 | 72 | 42 | 3 | - | 0-0-0-10-130 |
| acceptor, intron 14 | KKH-SaBE3 | GUAAAGACCUAAGU GAGAAA | 1808 | (AATAAT) | 20 (C8/9) | 6.9 | 75 | 50 | 82 | 55 | 84 | 26 | 6 | - | 0-0-1-7-59 |
| acceptor, intron 9 | SpBE3 | ACGCAGCGUCUAGG GAAAAA | 1809 | (TGG) | 20 (C10) | 6.7 | 75 | 37 | 82 | 30 | 40 | 48 | 6 | - | 0-0-0-2-73 |
| donor, intron 1 | VQR-SpBE3 | UUACUUGCAACCUA GCCCGC | 1810 345 | (CGAT) | 20 (C4) | 3.9 | 93 | 63 | 63 | 74 | 59 | 45 | 3 | + | 0-0-0- |
| donor, intron 22 | KKH-SaBE3 | GGACACUUACAACU UGAAGC | 1811 | (AGAGAT) | 20 (C10) | 7.3 | 95 | 53 | 61 | 39 | 72 | -6 | 7 | - | 0-0-0-0-8 |
| donor, intron 12 | KKH-SaBE3 | GAUUGGUCGUGCCC UAAAAA | 1812 | (AAAAAT) | 20 (C13/14) | 4.5 | 98 | 25 | 56 | 39 | 70 | 40 | 4 | - | 0-0-0-0-4 |
| acceptor, intron 8 | VQR-SpBE3 | CUGGACACUGACUA CACACG | 1813 | (AGAA) | 20 (C12) | 5.5 | 85 | 69 | 69 | 75 | 67 | 61 | 5 | + | 0-0-1-7-86 |

TABLE 9-continued

Exemplary Efficiency and Specificity Scores for gRNAs for Alteration of Intron/Exon Junctions in NaV1.7 (SN9A) Gene via Base Editing

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Housden | Prox/GC | Off targets[d] |
|---|---|---|---|---|---|---|---|---|---|---|---|---|---|---|---|
| acceptor, intron 26 | KKH-SaBE3 | AAACAUACCUGUAU GUGGAG | 1814 | (GAAAAT) | 20 (C9) | 6.2 | 90 | 63 | 62 | 15 | 70 | 43 | 6 | + | 0-0-0-1-20 |
| donor, intron 15 | SpBE3 | UUUACCAGUCUGAA UGAUCG | 1815 | (CAG) | 20 (C5/6) | 6.4 | 83 | 69 | 70 | 50 | 57 | 26 | 6 | - | 0-0-2-3-86 |
| donor, intron 16 | St3BE3 | ACCUAUAUCAGGGU GGGGAG | 1816 | (AGGGG) | 20 (C3/4) | 6.9 | 72 | 44 | 80 | 9 | 53 | 40 | 6 | + | 0-0-0-7-85 |
| acceptor, intron 16 | St3BE3 | UUAGGACCUAUAUC AGGGUG | 1817 | (GGGAG) | 20 (C8/9) | 3.9 | 91 | 61 | 41 | 40 | 66 | 73 | 3 | + | 0-0-1-7-60 |
| acceptor, intron 21 | St1BE3 | UCACAACGACCUAG UAUUCA | 1818 | (AAAGAAA) | 20 (C11) | 5.7 | 99 | 50 | 52 | 1 | 31 | 15 | 5 | - | 0-0-0-0-9 |
| acceptor, intron 25 | KKH-SaBE3 | UUGUUCUGCAAAGA AAUAAG | 1819 | (AATAAT) | 20 (C6) | 5.6 | 67 | 43 | 84 | 47 | 61 | 41 | 5 | - | 0-0-2-9-62 |
| donor, intron 26 | St1BE3 | CCUGUAUGUGGAGG AAAAUA | 1820 | (ATAGAAA) | 20 (C2) | 4.2 | 85 | 31 | 66 | 7 | 36 | 50 | 4 | - | 0-0-0-749 |
| donor, intron 12b | St1BE3 | AAAACGUCCUUACG CUGUCA | 1821 | (TCAGAAG) | 20 (C13) | 3.6 | 98 | 53 | 27 | 2 | 65 | 30 | 3 | - | 0-0-0-1-8 |
| acceptor, intron 6 | VQR-SpBE3 | UCUUCAGGCCUGAA AAUGGG | 1822 | (AGAA) | 20 (C9/10) | 6.6 | 56 | 67 | 94 | 74 | 77 | 54 | 6 | - | 0-0-2-23-213 |
| donor, intron 25 | SaBE3 | UAUUUUUUACCCC UGGUCG | 1823 | (AGGAAT) | 20 (C11/12) | 3.7 | 98 | 52 | 35 | 18 | 59 | 24 | 3 | + | 0-0-0-0-10 |
| donor, intron 1 | KKH-SaBE3 | ACUUACUUGCAACC UAGCCC | 1824 | (GCCGAT) | 20 (C6) | 7.2 | 97 | 52 | 36 | 31 | 74 | 14 | 7 | + | 0-0-0-2-9 |
| donor, intron 25 | VQR-SpBE3 | AUUUUUUACCCCU GGUCGA | 1825 | (GGAA) | 20 (C10/11) | 8.0 | 83 | 60 | 66 | 49 | 47 | 32 | 8 | + | 0-0-1-12-133 |
| donor, intron 2 | VQR-SpBE3 | UACUAUGAAAGUCU GCAGGA | 1826 | (GGAA) | 20 (C13) | 5.3 | 62 | 63 | 86 | 28 | 64 | 37 | 5 | + | 0-0-5-14-194 |
| donor, intron 26 | VQR-SpBE3 | AAUAUUCUUACCUA CAAUGG | 1827 | (AGAT) | 20 (C11/12) | 4.2 | 63 | 62 | 85 | 15 | 80 | 51 | 4 | - | 0-0-2-22-264 |
| acceptor, intron 4 | SaBE3 | ACCUAAACACAAGA UUCCAU | 1828 | (TGGGAT) | 20 (C2/3) | 6.7 | 91 | 56 | 28 | 11 | 58 | 26 | 6 | - | 0-0-1-1-18 |

TABLE 9-continued

Exemplary Efficiency and Specificity Scores for gRNAs for Alteration of Intron/Exon Junctions in NaV1.7 (SNA9A) Gene via Base Editing

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Prox/GC | Off targets[d] |
|---|---|---|---|---|---|---|---|---|---|---|---|---|---|---|---|
| acceptor, intron 1 | KKH-SaBE3 | AGAGCCUGGAUGG AAACAA | 1829 | (AGAAAT) | 20 (C6/7) | 6.8 | 80 | 60 | 66 | 52 | 81 | 75 | 6 | − | 0-0-3-3-20 |
| donor, intron 20 | KKH-SaBE3 | AGUACCUACAA CAAUUA | 1830 | (GGAAAT) | 20 (C9) | 4.6 | 87 | 41 | 59 | 9 | 46 | 33 | 4 | − | 0-0-1-4-23 |
| donor, intron 22 | SpBE3 | GACACUUACAACUU GAAGCA | 1831 | (GAG) | 20 (C9) | 5.3 | 62 | 63 | 83 | 47 | 76 | 33 | 5 | − | 0-0-4-13-121 |
| acceptor, intron 18 | SpBE3 | CCAUACACAACCUG ACAGA | 1832 | (AAG) | 20 (C11/12) | 2.7 | 74 | 57 | 70 | 14 | 67 | 24 | 2 | − | 0-0-1-8-88 |
| acceptor, intron 9 | KKH-SaBE3 | CGCAGCGUCUAGGG AAAAAU | 1833 | (GGAAAT) | 20 (C9) | 6.0 | 98 | 44 | 17 | 28 | 29 | 52 | 6 | − | 0-0-0-0-2 |
| donor, intron 14 | SpBE3 | GAGACUUACCAAAU UUCCUA | 1834 | (TAG) | 20 (C5/6) | 7.4 | 67 | 49 | 75 | 14 | 77 | 32 | 7 | − | 0-0-1-18-121 |
| donor, intron 6 | St3BE3 | UUGUCUUCAGGCCU GAAAAU | 1835 | (GGGAG) | 20 (C12/13) | 5.8 | 92 | 49 | 33 | 25 | 32 | 59 | 5 | − | 0-0-1-3-22 |
| donor, intron 6 | KKH-SaBE3 | UUCCUACCUGGGAU UACAGA | 1836 | (AATAGT) | 20 (C7/8) | 5.3 | 89 | 52 | 37 | 17 | 49 | 45 | 5 | − | 0-0-1-2-14 |
| acceptor, intron 16 | SpBE3 | UUUAGGACCUAUAU CAGGGU | 1837 | (GGG) | 20 (C9/10) | 7.5 | 80 | 60 | 15 | 17 | 69 | 48 | 7 | + | 0-0-1-11-87 |
| donor, intron 12b | KKH-SaBE3 | AACGUCCUUACGCU GUCAUC | 1838 | (AGAAGT) | 20 (C11) | 6.4 | 95 | 45 | 34 | 4 | 28 | 46 | 6 | − | 0-0-0-1-4 |
| acceptor, intron 16 | SpBE3 | AGGACCUAUAUCAG GGUGGG | 1839 | (GAG) | 20 (C6/7) | 5.1 | 50 | 53 | 89 | 8 | 64 | 72 | 5 | + | 0-0-3-23-231 |
| acceptor, intron 16 | SpBE3 | UUAGGACCUAUAUC AGGGUG | 1840 | (GGG) | 20 (C8/9) | 3.9 | 77 | 61 | 41 | 40 | 66 | 73 | 3 | + | 0-0-1-19-153 |
| donor, intron 6 | EQR-SpBE3 | UGUCUUCAGGCCUG AAAAUG | 1841 | (GGAG) | 20 (C11/12) | 4.8 | 55 | 54 | 83 | 1 | 43 | 53 | 4 | − | 0-0-3-26-246 |
| donor, intron 26 | St3BE3 | AUAAAUAUUCUUAC CUACAA | 1842 | (TGGAG) | 20 (C14/15) | 5.7 | 88 | 50 | 27 | 15 | 59 | 35 | 5 | − | 0-0-1-5-55 |
| acceptor, intron 26 | KKH-SaBE3 | CAUACCUGUAUGUG GAGGAA | 1843 | (AATAAT) | 20 (C6) | 4.3 | 81 | 56 | 50 | 6 | 48 | 42 | 4 | − | 0-0-0-1-28 |

TABLE 9-continued

Exemplary Efficiency and Specificity Scores for gRNAs for Alteration of Intron/Exon Junctions in NaV1.7 (SN9A) Gene via Base Editing

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Prox/GC | Off targets[d] |
|---|---|---|---|---|---|---|---|---|---|---|---|---|---|---|---|
| donor, intron 15 | St1BE3 | GUUUACCAGUCUGAAUGAUC | 1844 | (GCAGAAC) | 20 (C6/7) | 6.1 | 94 | 43 | 23 | 1 | 42 | 38 | 6 | - | 0-0-0-3-14 |
| donor, intron 13 | VQR-SpBE3 | GAUUAUUACAUACCUUCCAC | 1845 | (AGTG) | 20 (C13/14) | 3.4 | 76 | 55 | 60 | 7 | 73 | 28 | 3 | - | 0-0-0-7-137 |
| donor, intron 2 | SpBE3 | UCACCUUUUUGUCUGCAUAG | 1846 | (TAG) | 20 (C4/5) | 5.9 | 65 | 45 | 71 | 6 | 42 | 16 | 5 | - | 0-0-1-21-176 |
| acceptor, intron 2 | St1BE3 | AUGAAAGUCUGCAGGAGGAA | 1847 | (AAAGAAA) | 20 (C9) | 5.0 | 77 | 52 | 58 | 14 | 63 | 44 | 5 | - | 0-0-1-4-118 |
| donor, intron 12b | SpBE3 | AAACGUCCUUACGCUGUCAU | 1848 | (CAG) | 20 (C12) | 5.6 | 82 | 53 | 14 | 14 | 46 | 62 | 5 | - | 0-0-1-14-25 |
| donor, intron 4 | KKH-SaBE3 | CACUUACUCGACAUUUUUGG | 1849 | (TCCAGT) | 20 (C7) | 6.5 | 91 | 44 | 39 | 51 | 51 | 39 | 6 | - | 0-0-0-1-7 |
| donor, intron 9 | KKH-SaBE3 | CUUGUACUCCACCUGUUGGU | 1850 | (AAAGGT) | 20 (C12/13) | 9.4 | 92 | 43 | 29 | 31 | 42 | 39 | 9 | - | 0-0-2-1-11 |
| acceptor, intron 10 | VQR-SpBE3 | GCAAUUGCCUGGUUGGGCCA | 1851 | (AGAC) | 20 (C8/9) | 5.6 | 79 | 54 | 55 | 36 | 82 | 49 | 5 | + | 0-0-2-9-83 |
| donor, intron 12b | VQR-SpBE3 | AACGUCCUUACGCUGUCAUC | 1852 | (AGAA) | 20 (C11) | 6.4 | 89 | 45 | 34 | 4 | 28 | 46 | 6 | - | 0-0-0-2-33 |
| acceptor, intron 18 | VQR-SpBE3 | CAUACACAACCUGACAAGAA | 1853 | (AGAC) | 20 (C10/11) | 7.1 | 50 | 54 | 84 | 9 | 48 | 51 | 7 | - | 0-0-5-39-478 |
| acceptor, intron 13 | St1BE3 | AAGUUCUGGGAGAAAAAAGC | 1854 | (AGAGAAC) | 20 (C6) | 4.9 | 81 | 52 | 40 | 6 | 73 | 43 | 4 | - | 0-0-0-13-84 |
| donor, intron 16 | KKH-SaBE3 | UGGUUACAUACCACCAGGUU | 1855 | (TCCAAT) | 20 (C12) | 4.5 | 91 | 42 | 10 | 3 | 43 | 55 | 4 | - | 0-0-0-3-12 |
| donor, intron 22 | St1BE3 | UGCCUUUAAGAAUAACAUUA | 1856 | (ATAGAAT) | 20 (C3/4) | 2.9 | 84 | 21 | 48 | 4 | 33 | 14 | 2 | - | 0-0-0-7-68 |
| acceptor, intron 1 | St1BE3 | UAAGAGGCCUGGAUGGAAAC | 1857 | (AAAAGAAA) | 20 (C8/9) | 6.2 | 93 | 36 | 37 | 6 | 53 | 50 | 6 | -1 | 0-0-0-38 |
| donor, intron 22 | EQR-SpBE3 | GGACACUUACAACUUGAAGC | 1858 | (AGAG) | 20 (C9) | 7.3 | 69 | 53 | 61 | 39 | 72 | -6 | 7 | - | 0-0-2-11-129 |

TABLE 9-continued

Exemplary Efficiency and Specificity Scores for gRNAs for Alteration of Intron/Exon Junctions in NaV1.7 (SNA9A) Gene via Base Editing

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Prox/GC | Off targets[d] |
|---|---|---|---|---|---|---|---|---|---|---|---|---|---|---|---|
| donor, intron 25 | SpBE3 | UAUUUUUUACCCCUGGUCG | 1859 | (AGG) | 20 (C11/12) | 3.7 | 78 | 52 | 35 | 18 | 59 | 24 | 3 | + | 0-0-1-12-87 |
| donor, intron 4 | KKH-SaBE3 | AUACCCACUACUCGACAUU | 1860 | (TTTGGT) | 20 (C12) | 5.4 | 99 | 30 | 18 | 16 | 27 | 33 | 5 | − | 0-0-0-0-4 |
| donor, intron 4 | SpBE3 | CUUACUCGACAUUUUUGGUC | 1861 | (CAG) | 20 (C5) | 8.7 | 80 | 48 | 9 | 12 | 32 | 31 | 8 | − | 0-0-0-5-56 |
| donor, intron 9 | SpBE3 | UGGUACUCCACCUGUUGGUAA | 1862 | (AGG) | 20 (C10/11) | 8.3 | 82 | 46 | 2 | 20 | 44 | 52 | 8 | − | 0-0-1-9-84 |
| acceptor, intron 16 | SaBE3 | AAUAGGUUUAGGACCUAUAU | 1863 | (CAGGGT) | 20 (C15/16) | 4.3 | 91 | 36 | 7 | 5 | 43 | 34 | 4 | − | 0-0-0-6-11 |
| acceptor, intron 21 | VQR-SpBE3 | ACAACGACCUAGUAUUCAAA | 1864 | (AGAA) | 20 (C9) | 4.1 | 76 | 51 | 50 | 41 | 66 | 31 | 4 | − | 0-0-0-4-113 |
| acceptor, intron 22 | SaBE3 | GCCUUUAAGAAUAACAUUAA | 1865 | (TAGAAT) | 20 (C2/3) | 5.9 | 89 | 24 | 38 | 3 | 42 | 26 | 4 | − | 0-0-0-1-38 |
| donor, intron 11 | SpBE3 | GGGUGGUACCUGAUUGGGGG | 1866 | (TAG) | 20 (C9/10) | 7.7 | 70 | 47 | 57 | 17 | 90 | 60 | 7 | + | 0-0-2-12-152 |
| acceptor, intron 21 | SpBE3 | ACGACCUAGUAUUCAAAAGA | 1867 | (AAG) | 20 (C6) | 4.9 | 72 | 54 | 45 | 16 | 69 | 33 | 4 | − | 0-0-1-6-79 |
| acceptor, intron 26 | VQR-SpBE3 | GAAACAUACCUGUAUGUGGA | 1868 | (GGAA) | 20 (C10) | 4.9 | 63 | 63 | 60 | 33 | 66 | 45 | 4 | − | 0-0-0-21-206 |
| donor, intron 2 | KKH-SaBE3 | UAAACUCACACUUUUUGUCUG | 1869 | (CATAGT) | 20 (C9/10) | 8.0 | 57 | 57 | 68 | 6 | 42 | 37 | 8 | − | 0-0-1-5-21 |
| donor, intron 8 | VQR-SpBE3 | UACAUACCCUGAAUCUGUGC | 1870 | (TGAA) | 20 (C7/8) | 5.8 | 75 | 50 | 8 | 6 | 62 | 12 | 5 | + | 0-0-0-15-118 |
| acceptor, intron 26 | EQR-SpBE3 | CUAGAAACAUACCUGUAUGU | 1871 | (GGAG) | 20 (C13) | 6.2 | 66 | 58 | 16 | 18 | 50 | 34 | 6 | − | 0-0-0-19-215 |
| acceptor, intron 21 | VQR-SpBE3 | CGACCUAGUAUUCAAAGAA | 1872 | (AGAA) | 20 (C5) | 3.6 | 59 | 51 | 64 | 20 | 65 | 43 | 3 | − | 0-0-1-10-143 |
| acceptor, intron 22 | KKH-SaBE3 | AAGUGCCUUUAAGAAUAAC | 1873 | (ATTAAT) | 20 (C7/8) | 4.4 | 87 | 36 | 23 | 11 | 39 | 38 | 4 | − | 0-0-0-735 |

TABLE 9-continued

Exemplary Efficiency and Specificity Scores for gRNAs for Alteration of Intron/Exon Junctions in NaV1.7 (SN9A) Gene via Base Editing

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Pro x/GC | Off targets[d] |
|---|---|---|---|---|---|---|---|---|---|---|---|---|---|---|---|
| donor, intron 11 | VQR-SpBE3 | GGUGGUACCUGAUU GGGGGu | 1874 | (AGAC) | 20 (C8/9) | 6.8 | 73 | 50 | 43 | 22 | 78 | 63 | 6 | + | 0-0-5-13-84 |
| donor, intron 2 | St3BE3 | CACCUUUUGUCUG CAUAGU | 1875 | (AGGGG) | 20 (C3/4) | 3.8 | 91 | 32 | 7 | 1 | 13 | 41 | 3 | - | 0-0-0-2-31 |
| acceptor, intron 4 | SpBE3 | ACCUAAACACAAGA UUCCAU | 1876 | (TGG) | 20 (C2/3) | 6.7 | 66 | 56 | 28 | 11 | 58 | 26 | 6 | - | 0-0-3-17-119 |
| acceptor, intron 9 | VQR-SpBE3 | CGCAGCGUCUAGGG AAAAAU | 1877 | (GGAA) | 20 (C9) | 6.0 | 78 | 44 | 17 | 28 | 29 | 52 | 6 | - | 0-0-0-4-61 |
| donor, intron 11 | St3BE3 | AAUUGGGUGGUAC CUGAUU | 1878 | (GGGGG) | 20 (C14/15) | 5.3 | 96 | 26 | 9 | 2 | 36 | 67 | 5 | - | 0-0-0-3-31 |
| donor, intron 2 | SpBE3 | CCUUUUGUCUGCA UAGUAG | 1879 | (GGG) | 20 (C1/2) | 6.0 | 66 | 56 | 38 | 61 | 59 | 37 | 6 | - | 0-0-3-22-194 |
| donor, intron 25 | SpBE3 | UUUACCCCUGGUCG AGGAAU | 1880 | (TGG) | 20 (C5/6) | 5.1 | 89 | 33 | 8 | 13 | 26 | 52 | 5 | - | 0-0-0-8-52 |
| donor, intron 5 | VQR-SpBE3 | UACUACGCAAAAA CAAUGA | 1881 | (CGAC) | 20 (C7) | 4.1 | 56 | 62 | 66 | 22 | 75 | 29 | 4 | - | 0-0-2-14-257 |
| acceptor, intron 16 | SaBE3 | CCUAUAUCAGGGUG GGGAGA | 1882 | (GGGGGT) | 20 (C2/3) | 3.8 | 76 | 45 | 25 | 4 | 47 | 56 | 3 | + | 0-0-0-1-30 |
| donor, intron 11 | SaBE3 | AAUUUGGGUGGUAC CUGAUU | 1883 | (GGGGGT) | 20 (C14/15) | 5.3 | 95 | 26 | 9 | 2 | 36 | 67 | 5 | - | 0-0-0-2-5 |
| donor, intron 9 | SpBE3 | UUGGUACUCACCUG UUGGUA | 1884 | (AAG) | 20 (C11/12) | 3.7 | 83 | 38 | 12 | 0 | 37 | 54 | 3 | - | 0-0-1 |
| donor, intron 19 | EQR-SpBE3 | AUUUACCAGGCAC CACUGC | 1885 | (TGAG) | 20 (C6/7) | 6.4 | 67 | 40 | 53 | 1 | 55 | 10 | 6 | + | 0-0-3-22-108 |
| donor, intron 13 | KKH-SaBE3 | ACAUACCUUCCACA GUGUUU | 1886 | (GTTAAT) | 20 (C6/7) | 6.3 | 79 | 41 | 30 | 13 | 33 | 31 | 6 | - | 0-0-0-3-38 |
| donor, intron 9 | KKH-SaBE3 | CACCUGUUGGUAAA GGUUU | 1887 | (CCCAGT) | 20 (C3/4) | 5.2 | 93 | 26 | 7 | 3 | 7 | 27 | 5 | - | 0-0-0-1-14 |
| donor, intron 14 | KKH-SaBE3 | GACUUACCAAAUUU CCUAUA | 1888 | (GCAAGT) | 20 (C7/8) | 6.2 | 83 | 35 | 29 | 15 | 36 | 52 | 6 | - | 0-0-0-4-31 |

TABLE 9-continued

Exemplary Efficiency and Specificity Scores for gRNAs for Alteration of Intron/Exon Junctions in NaV1.7 (SNA9A) Gene via Base Editing

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Prox/GC | Off targets[d] |
|---|---|---|---|---|---|---|---|---|---|---|---|---|---|---|---|
| donor, intron 22 | VQR-SpBE3 | ACACUUACAACUUGAAGCAG | 1889 | (AGAT) | 20 (C8) | 3.5 | 55 | 63 | 62 | 38 | 87 | 45 | 3 | - | 0-0-9-16-173 |
| donor, intron 6 | St1BE3 | AUUACUCUUACCUGGGAUU | 1890 | (ACAGAAA) | 20 (C12/13) | 7.0 | 91 | 27 | 13 | 3 | 29 | 37 | 7 | - | 0-0-1-4-30 |
| acceptor, intron 10 | SpBE3 | UGCAAUUGCCUGGUUGGGCC | 1891 | (AAG) | 20 (C9/10) | 7.8 | 74 | 43 | 11 | 8 | 40 | 37 | 7 | + | 0-0-1-15-146 |
| donor, intron 15 | SpBE3 | CGGAGCUAAAAGCAAAUAUA | 1892 | (AAG) | 20 (C6) | 4.6 | 65 | 35 | 52 | 11 | 36 | 46 | 4 | - | 0-0-2-16-105 |
| acceptor, intron 15 | KKH-SaBE3 | CUCGGAGCUAAAAGCAAAUA | 1893 | (TAAAGT) | 20 (C8) | 4.8 | 88 | 28 | 29 | 7 | 33 | 42 | 4 | - | 0-0-0-1-16 |
| donor, intron 2 | SaBE3 | CACCUUUUGUCUGCAUAGU | 1894 | (AGGGGT) | 20 (C3/4) | 3.8 | 84 | 32 | 7 | 1 | 13 | 41 | 3 | - | 0-0-1-15-17 |
| acceptor, intron 2 | SpBE3 | AACUCACCUUUUGUCUGCA | 1895 | (TAG) | 20 (C7/8) | 3.7 | 65 | 49 | 12 | 13 | 29 | 20 | 3 | - | 0-0-0-20-206 |
| donor, intron 1 | VQR-SpBE3 | AGAGGCCUGGAUGGAAACAA | 1896 | (AGAA) | 20 (C6/7) | 6.8 | 46 | 60 | 66 | 52 | 81 | 75 | 6 | - | 0-0-5-54-404 |
| donor, intron 20 | VQR-SpBE3 | AGUACCUACACAACAAUUA | 1897 | (GGAA) | 20 (C9) | 4.6 | 52 | 41 | 59 | 9 | 46 | 33 | 4 | - | 0-0-3-53-739 |
| acceptor, intron 7 | SaBE3 | AUAAAAAUAUUCUGUUGAAG | 1898 | (AAGAAT) | 20 (C12) | 3.8 | 58 | 53 | 50 | 8 | 53 | 22 | 3 | - | 0-0-8-13-102 |
| acceptor, intron 16 | St3BE3 | CCUAUAUCAGGGUGGGAGA | 1899 | (GGGGG) | 20 (C2/3) | 3.8 | 64 | 45 | 25 | 4 | 47 | 56 | 3 | + | 0-0-0-12-144 |
| acceptor, intron 23 | KKH-SaBE3 | UGUCUACCUAUAAAAUUUAC | 1900 | (AAAAGT) | 20 (C7/8) | 4.3 | 78 | 31 | 9 | 17 | 26 | 16 | 4 | - | 0-0-0-3-55 |
| acceptor, intron 5 | St1BE3 | UAAAUACCUGUAGAAUUAAA | 1901 | (TCAGAAT) | 20 (C7/8) | 4.1 | 68 | 16 | 41 | 10 | 40 | 39 | 4 | - | 0-0-1-17-167 |
| donor, intron 4 | SpBE3 | ACCCACUUACUCGACAUUU | 1902 | (TGG) | 20 (C10) | 7.1 | 86 | 20 | 8 | 4 | 7 | 12 | 7 | - | 0-0-1-4-58 |
| acceptor, intron 25 | St1BE3 | GAUUUGUUCUGCAAAGAAA | 1903 | (TAAGAAT) | 20 (C10) | 5.9 | 68 | 35 | 37 | 15 | 76 | 33 | 5 | - | 0-0-3-16-104 |

TABLE 9-continued

Exemplary Efficiency and Specificity Scores for gRNAs for Alteration of Intron/Exon Junctions in NaV1.7 (SN9A) Gene via Base Editing

| Target variants | BE type[a] | Programmable guide-RNA sequence | SEQ ID NOs | PAM | gRNA size (C edited) | Eff[b] | Hsu[c] | Fusi | Chari | Doench | Wang | M.-M. | Hous-den | Prox/GC | Off targets[d] |
|---|---|---|---|---|---|---|---|---|---|---|---|---|---|---|---|
| donor, intron 21 | KKH-SaBE3 | UUACCCUCAUUCCUUCAAAU | 1904 | (CTAGAT) | 20 (C4/5) | 5.2 | 64 | 40 | 20 | 51 | 30 | 21 | 5 | - | 0-1-1-3-19 |
| donor, intron 25 | EQR-SpBE3 | UAUAUUUUUUACCccuGgu | 1905 | (CGAG) | 20 (C13/14) | 4.1 | 51 | 53 | 36 | 12 | 37 | 25 | 4 | + | 0-0-3-38-413 |
| donor, intron 3 | KKH-SaBE3 | UAGUACACUCAUAUccuuuu | 1906 | (AAAAAT) | 20 (C8/10) | 9.1 | 90 | 10 | 4 | 4 | 18 | 42 | 9 | - | 0-0-0-2-26 |
| donor, intron 21 | VQR-SpBE3 | ACCCUCAUUCCUUCAAAUCU | 1907 | (AGAT) | 20 (C2/3) | 5.6 | 62 | 36 | 3 | 1 | 28 | 12 | 5 | - | 0-0-4-22-199 |
| donor, intron 8 | VQR-SpBE3 | AAUAUUACAUACCCUGAAUC | 1908 | (TGTG) | 20 (C12/13) | 4.5 | 63 | 31 | 16 | 2 | 39 | 12 | 4 | - | 0-0-2-13-223 |
| donor, intron 20 | SpBE3 | AAGUACCUACAUCAACAAUU | 1909 | (AGG) | 20 (C10) | 6.6 | 53 | 40 | 36 | 16 | 43 | 42 | 6 | - | 0-0-8-38-315 |
| donor, intron 2 | SpBE3 | CACCUUUUGUCUGCAUAGU | 1910 | (AGG) | 20 (C3/4) | 3.8 | 60 | 32 | 7 | 1 | 13 | 41 | 3 | - | 0-0-3-25-159 |
| donor, intron 22 | SpBE3 | UUACAACUUGAAGCAGAGAU | 1911 | (AGG) | 20 (C4) | 4.6 | 41 | 47 | 37 | 45 | 44 | 56 | 4 | - | 0-0-10-36-283 |

[a]BE types: SpBE3 = APOBEC1-SpCas9n-UGI; VQR-SpBE3 = APOBEC1-VQR-SpCas9n-UGI; EQR-SpBE3 = APOBEC1-EQR-SpCas9n-UGI; VRER-SpBE3 = APOBEC1-VRER-SpCas9n-UGI; SaBE3 = APOBEC1-SaCas9n-UGI; KKH-SaBE3 = APOBEC1-KKH-SaCas9n-UGI; St3BE3 = APOBEC1-st3Cas9n-UGI; St1BE3 = APOBEC1-St1Cas9n-UGI.
[b]Efficiency score, based on Housden et al (Science Signaling, 2015, 8 (393):rs9).
[c]Specificity scores based on Hsu et al (Nature biotechnology, 2013, 31 (9):827-832), Fusi et al (bioRxiv 021568; doi: http://dx.doi.org/10.1101/021568), Chari et al (Nature Methods, 2015, 12 (9):823-6), Doench et al (Nature biotechnology, 2014, 32 (12):1262-7), Wang et al (Science, 2014, 343 (6166): 80-4), Moreno-Mateos et al (Nature Methods, 2015, 12 (10):982-8), Housden et al (Science Signaling, 2015, 8 (393):rs9), and the "Prox/GC" column shows "+" if the proximal 6 bp to the PAM has a GC count > = 4, and GG if the guide ends with GG, based on Farboud et al (Genetics, 2015, 199 (4):959-71).
[d]Number of predicted off-target binding sites in the human genome allowing up to 0, 1, 2, 3 or 4 mismatches, respectively shown in the format 0-1-2-3-4. Algorithm used: Haeussler et al, Genome Biol. 2016; 17: 148. Isoform 2 is expressed preferentially in the dorsal root ganglion.

Editing the SCN9A Gene Using Cas9 Nuclease or Cas9 Nickase Pairs

In some embodiments, the editing of an ion channel-encoding polynucleotide (e.g., SCN9A gene) may be achieved using Cas9 nucleases, or Cas9 nickase pairs (e.g., as described in Ran et al., *Cell.* 2013 Sep. 12; 154(6): 1380-1389., incorporated herein by reference. Cas9 nuclease or Cas9 nickase pairs introduce double stranded DNA break in the ion channel-encoding polynucleotide (e.g., SCN9A gene). Indels may be introduced when the double strand break is repaired by the cellular double strand break repair system, causing loss-of-function SCN9A mutants. The use of Cas9 nuclease to generate SCN9A mutation have been described in the art, e.g., in Sun et al., *Transl Perioper Pain Med.* 2016; 1(3): 22-33, incorporated herein by reference.

Nonetheless, provided herein are top-scoring guide-RNA target sites in SCN9A gene using these alternative genome editing agents (Table 10 and Table 11).

TABLE 10

Top-Scoring Guide-RNA Target Sites and PAM Sequences in SCN9A for Cas9 Nuclease

| Entry | Position | Strand | Guide-RNA target site (PAM) | SEQ ID NOs | Specificity score[50] | Efficiency score[28] |
|---|---|---|---|---|---|---|
| 1 | 350 | -1 | GAGCACGGGCGAAAGACCGA (GGG) | 1912 | 94 | 67 |
| 2 | 439 | 1 | GTATTACGCCACCTGGAAAG (AAG) | 1913 | 81 | 70 |
| 3 | 532 | -1 | ACAGAGTCAAAACCGCACAG (GAG) | 1914 | 84 | 89 |
| 4 | 534 | -1 | CCACAGAGTCAAAACCGCAC (AGG) | 1915 | 84 | 60 |
| 5 | 753 | 1 | AGCTTAGCAGATACAACCTG (TGG) | 1916 | 60 | 72 |
| 6 | 755 | 1 | CTTAGCAGATACAACCTGTG (GGG) | 1917 | 70 | 73 |
| 7 | 837 | 1 | TCTGCCCCTATTTCTCAGCG (CAG) | 1918 | 75 | 83 |
| 8 | 1555 | -1 | TCATGAAAATTTGCGACACA (GGG) | 1919 | 84 | 66 |
| 9 | 2064 | -1 | CTACTTTTTCCTTGCCACA (GAG) | 1920 | 51 | 81 |
| 10 | 2380 | -1 | GCTGAAATGGAGTAATAAGG (AAG) | 1921 | 61 | 85 |
| 11 | 2596 | -1 | ATAGAGAATGAATTGCAGGG (GAG) | 1922 | 52 | 87 |
| 12 | 2846 | -1 | ATGTGTTTTAGCCACGACCT (GGG) | 1923 | 90 | 62 |
| 13 | 3685 | -1 | AAACATCAATTTAGACCGTG (TGG) | 1924 | 83 | 64 |
| 14 | 5589 | -1 | AAAACATTAGCCGGGCACGG (TGG) | 1925 | 78 | 71 |
| 15 | 5724 | -1 | AGATAATGGGCTGAGCGCGG (TGG) | 1926 | 88 | 65 |
| 16 | 6504 | 1 | GGCCTACTCAGGGATCAACT (GGG) | 1927 | 82 | 66 |
| 17 | 7409 | 1 | GGAGTGCAGTGGTACGATGT (TGG) | 1928 | 89 | 62 |
| 18 | 7790 | -1 | TGGTCATGAGGATTTAAACG (GAG) | 1929 | 77 | 77 |
| 19 | 7963 | 1 | CCCCACACAGATATACCTGG (TGG) | 1930 | 69 | 76 |
| 20 | 7967 | -1 | TGCTTGGTAGCGTAACCACC (AGG) | 1931 | 92 | 61 |
| 21 | 8465 | 1 | ACGCCCGTAATCCAGCACTT (TGG) | 1932 | 89 | 67 |
| 22 | 10500 | 1 | GGGATTACTAACCTGCGTCG (AGG) | 1933 | 95 | 65 |
| 23 | 10501 | 1 | GGATTACTAACCTGCGTCGA (GGG) | 1934 | 98 | 61 |
| 24 | 10501 | -1 | TTATCACGCAGCCCTCGACG (CAG) | 1935 | 96 | 71 |
| 25 | 11027 | 1 | CTAGCAAAACAGATACCAAG (GAG) | 1936 | 59 | 81 |
| 26 | 11046 | 1 | GGAGACACCGCATGTTGTCA (GGG) | 1937 | 83 | 62 |
| 27 | 11105 | -1 | GTGTTTTGAGATCCGTAAGG (CAG) | 1938 | 90 | 71 |
| 28 | 11108 | -1 | AGCGTGTTTTGAGATCCGTA (AGG) | 1939 | 91 | 62 |
| 29 | 11121 | -1 | TTACGGATCTCAAAACACGC (TAG) | 1940 | 92 | 86 |
| 30 | 11466 | -1 | TTCTGATATATGCTACGACC (CGG) | 1941 | 92 | 60 |
| 31 | 12273 | -1 | TGAATCACAGACCTAAACGT (CAG) | 1942 | 79 | 79 |

TABLE 10-continued

Top-Scoring Guide-RNA Target Sites and PAM Sequences in SCN9A for Cas9 Nuclease

| Entry | Position | Strand | Guide-RNA target site (PAM) | SEQ ID NOs | Specificity score[50] | Efficiency score[28] |
|---|---|---|---|---|---|---|
| 32 | 12530 | -1 | GCAAGGATATTCTTTCCCAT (CAG) | 1943 | 59 | 81 |
| 33 | 12956 | -1 | TAGGGGACTTAACCTCCACA (AGG) | 1944 | 81 | 67 |
| 34 | 12973 | -1 | TGGGAAAAGGTATTGCCTAG (GGG) | 1945 | 70 | 74 |
| 35 | 14409 | -1 | TGGATACACTGAACACACCG (AGG) | 1946 | 85 | 73 |
| 36 | 14896 | -1 | AGTTCTTATATAGCAAACCG (GAG) | 1947 | 88 | 82 |
| 37 | 14921 | 1 | ATAAGAACTGAGCTTTAGAG (AAG) | 1948 | 55 | 84 |
| 38 | 15045 | 1 | GCTGTCTTACTATTTTACTG (CAG) | 1949 | 56 | 83 |
| 39 | 15387 | -1 | GTAATAACTTTGGCACCAGG (CAG) | 1950 | 67 | 91 |
| 40 | 15569 | 1 | ATAAAGTCTTAACTAACAGA (GAG) | 1951 | 52 | 89 |
| 41 | 15850 | -1 | GGAGAACTGCTTGAACCCGG (GAG) | 1952 | 71 | 72 |
| 42 | 17006 | 1 | TAGTTATCATTGGGACACCT (GGG) | 1953 | 82 | 63 |
| 43 | 17865 | 1 | AGTGAGCTGAGATCGCACCA (AGG) | 1954 | 82 | 82 |
| 44 | 18150 | -1 | ATTGGGTCTCCAATACCAAA (CAG) | 1955 | 75 | 75 |
| 45 | 18651 | 1 | GGCCCTGTAGGCGTTACACT (AGG) | 1956 | 92 | 62 |
| 46 | 18855 | 1 | GGTGGGAACAACACACACTG (GGG) | 1957 | 62 | 74 |
| 47 | 19346 | 1 | CCACATGGATGGATACACAA (GGG) | 1958 | 68 | 72 |
| 48 | 20999 | 1 | AGTCAGCTATGATTGCACCA (CAG) | 1959 | 75 | 88 |
| 49 | 21248 | -1 | GCTTGTACGCAAATAACAGG (GAG) | 1960 | 83 | 86 |
| 50 | 23890 | -1 | AGCCCTAAACCCGTAAAATG (GGG) | 1961 | 81 | 63 |
| 51 | 24449 | 1 | GCTCAGCTGAACCAGAGCAA (GAG) | 1962 | 58 | 89 |
| 52 | 24871 | -1 | AATCTGATTTGGCGACACAA (AGG) | 1963 | 83 | 63 |
| 53 | 25247 | -1 | TTGCCCACTGGTGATCACCA (GGG) | 1964 | 69 | 72 |
| 54 | 25468 | -1 | GTATGCATAGGGGTATACTT (TAG) | 1965 | 83 | 78 |
| 55 | 25928 | 1 | TATAGACAAGTCCACGAACC (AGG) | 1966 | 87 | 64 |
| 56 | 25930 | 1 | TAGACAAGTCCACGAACCAG (GAG) | 1967 | 85 | 73 |
| 57 | 26295 | -1 | ATACCTCAGACCGGGCATGG (TGG) | 1968 | 78 | 73 |
| 58 | 26495 | 1 | AATGAAGTGGAAGTACACAG (TAG) | 1969 | 55 | 81 |
| 59 | 26796 | 1 | ATAAGATGGTCACAGCTTGG (GGG) | 1970 | 63 | 74 |
| 60 | 26974 | 1 | TCCTGCCTCAGCCTTCCGAG (GAG) | 1971 | 55 | 84 |
| 61 | 27331 | -1 | GCTTATGGGATTAACCCACA (AGG) | 1972 | 80 | 65 |
| 62 | 27917 | 1 | GGAGCCACAGATTGTTAGCA (GAG) | 1973 | 71 | 75 |
| 63 | 28255 | -1 | ACACGGAAAACAAATCCAGG (AAG) | 1974 | 51 | 87 |
| 64 | 28522 | -1 | TGGGAGATCAACATGCCTAG (TGG) | 1975 | 69 | 73 |
| 65 | 29289 | 1 | GCACCTGCTCCATATTTAGT (AAG) | 1976 | 73 | 75 |
| 66 | 29487 | -1 | CTTGAGCCGTCAAAGACACA (CAG) | 1977 | 67 | 81 |
| 67 | 29862 | -1 | GTATTACCACTTCGTGAAAA (GAG) | 1978 | 85 | 62 |
| 68 | 29864 | 1 | GCTTGTTTACTCTTTTCACG (AAG) | 1979 | 66 | 91 |

TABLE 10-continued

Top-Scoring Guide-RNA Target Sites and PAM Sequences in SCN9A for Cas9 Nuclease

| Entry | Position | Strand | Guide-RNA target site (PAM) | SEQ ID NOs | Specificity score[50] | Efficiency score[28] |
|---|---|---|---|---|---|---|
| 69 | 29990 | 1 | CCATCTTTGTTGTTTCAAGG (CAG) | 1980 | 58 | 83 |
| 70 | 30043 | 1 | GAATACTCCCAAATTCAGGG (AGG) | 1981 | 67 | 76 |
| 71 | 30500 | 1 | AGAGCATACTGACCTCAACG (TGG) | 1982 | 83 | 77 |
| 72 | 30917 | 1 | TAGATACCCATCTTATACAC (AGG) | 1983 | 82 | 60 |
| 73 | 31112 | 1 | ACACTGCTGCTTCACATCAG (GGG) | 1984 | 61 | 70 |
| 74 | 31620 | -1 | GATACCATTAACTATCACCT (GGG) | 1985 | 73 | 71 |
| 75 | 33443 | 1 | GAGACTCTATTCTAAACGTG (AGG) | 1986 | 85 | 63 |
| 76 | 33616 | 1 | TAACTGCAGTAGTTGACCAT (TGG) | 1987 | 82 | 64 |
| 77 | 34247 | -1 | TTTGCTATGACACAGTACAG (AAG) | 1988 | 66 | 80 |
| 78 | 34544 | 1 | TCTTAGACGGTATAAAGTGG (GAG) | 1989 | 80 | 72 |
| 79 | 35281 | 1 | GAGGGTCACTTGAATCCCAG (AGG) | 1990 | 68 | 74 |
| 80 | 36749 | 1 | TTTTAAATTTGATTTCCGAA (GAG) | 1991 | 56 | 85 |
| 81 | 37237 | -1 | TTCGTGACCTGACAATTGGG (CAG) | 1992 | 83 | 72 |
| 82 | 37670 | 1 | AAGCCCTAAATCAATGCCGA (GGG) | 1993 | 84 | 61 |
| 83 | 37739 | 1 | GGGCATGTCCCTTTCATACA (GAG) | 1994 | 72 | 79 |
| 84 | 37955 | -1 | GCACTCTTCCCAGGATACAA (GAG) | 1995 | 55 | 92 |
| 85 | 38493 | -1 | GGAATATTCCTAGTCCCAAG (AGG) | 1996 | 77 | 72 |
| 86 | 38734 | 1 | CCTCTCATAAGAAATCACTG (GAG) | 1997 | 56 | 86 |
| 87 | 39328 | -1 | TACACTGTAAACGGCCTGAG (AGG) | 1998 | 85 | 66 |
| 88 | 39329 | -1 | TTACACTGTAAACGGCCTGA (GAG) | 1999 | 86 | 70 |
| 89 | 39457 | -1 | CCCCAAAATCGATTAAGCTG (AGG) | 2000 | 84 | 66 |
| 90 | 39551 | -1 | CCTCCCTCATGGGAACATGG (AGG) | 2001 | 62 | 70 |
| 91 | 40096 | -1 | GCACAGTCTGAGCATGTACA (GAG) | 2002 | 66 | 90 |
| 92 | 40431 | 1 | GGTGCTAGAGAACAGCCAAT (CAG) | 2003 | 73 | 92 |
| 93 | 41623 | -1 | CGTCATGTAGAATATGGCAG (AAG) | 2004 | 71 | 83 |
| 94 | 42582 | 1 | AAGACATGTTACATTGTAGG (GGG) | 2005 | 63 | 70 |
| 95 | 42636 | 1 | AGTCAACTCTGCAAAACAAG (GAG) | 2006 | 52 | 83 |
| 96 | 42662 | 1 | TTAATGAAAGCCAATCATCG (AGG) | 2007 | 74 | 74 |
| 97 | 42857 | 1 | ACTCTGGTAACTCCACCTGG (AGG) | 2008 | 66 | 76 |
| 98 | 43791 | -1 | AGCTATAGTAGAATCCTGTG (TGG) | 2009 | 76 | 75 |
| 99 | 43824 | 1 | TGTACATAGACCCAGCACAA (GGG) | 2010 | 71 | 76 |
| 100 | 45140 | 1 | TTAGGAACCAGGCTGCACAG (CAG) | 2011 | 60 | 89 |
| 101 | 45255 | 1 | TATTGTGAACTGCACATACG (AGG) | 2012 | 81 | 65 |
| 102 | 45256 | 1 | ATTGTGAACTGCACATACGA (GGG) | 2013 | 88 | 71 |
| 103 | 45416 | -1 | GATAACACCTGGCAATCCAG (CAG) | 2014 | 73 | 85 |
| 104 | 45427 | -1 | GCTCTCTTAGTGATAACACC (TGG) | 2015 | 81 | 60 |
| 105 | 46134 | 1 | AAACTGTTAACACAAGAGGG (AGG) | 2016 | 65 | 71 |

TABLE 10-continued

Top-Scoring Guide-RNA Target Sites and PAM Sequences in SCN9A for Cas9 Nuclease

| Entry | Position | Strand | Guide-RNA target site (PAM) | SEQ ID NOs | Specificity score[50] | Efficiency score[28] |
|---|---|---|---|---|---|---|
| 106 | 46321 | 1 | CAACAGACTGTAAGCCCTAG (AGG) | 2017 | 72 | 70 |
| 107 | 46346 | -1 | GGGACACAATACTAACTAGG (TGG) | 2018 | 81 | 72 |
| 108 | 46675 | -1 | GATTTTAAGGTTTACCCCCG (CAG) | 2019 | 87 | 79 |
| 109 | 47862 | -1 | TGACACTCTGGAACATTAGA (GAG) | 2020 | 71 | 73 |
| 110 | 47868 | 1 | TCACTCTCTCTAATGTTCCA (GAG) | 2021 | 59 | 81 |
| 111 | 47960 | -1 | TTAAGAGTATGAAATCCTAC (AAG) | 2022 | 64 | 84 |
| 112 | 48743 | 1 | GGAGGTCGCTTGAGTGCACG (AGG) | 2023 | 88 | 60 |
| 113 | 48893 | -1 | ATATTGCGTTTATACCACAG (AAG) | 2024 | 71 | 74 |
| 114 | 49353 | -1 | TTACCATTGAGAGATCCTTG (GAG) | 2025 | 71 | 72 |
| 115 | 50070 | 1 | AAGGTGATGTTATCGAACAT (AGG) | 2026 | 88 | 63 |
| 116 | 50074 | 1 | TGATGTTATCGAACATAGGA (GAG) | 2027 | 82 | 65 |
| 117 | 50130 | -1 | GACAAGGATACGCTTAACCC (TGG) | 2028 | 92 | 62 |
| 118 | 50147 | 1 | TTAAGCGTATCCTTGTCAGC (CAG) | 2029 | 87 | 69 |
| 119 | 50619 | -1 | GATCCATTAGAAATGCTGAT (CAG) | 2030 | 57 | 88 |
| 120 | 51722 | -1 | GCACTCCAGCCTGAACCAGA (GAG) | 2031 | 67 | 81 |
| 121 | 51778 | -1 | GGAGAATTACTTGAACCCAG (CAG) | 2032 | 54 | 82 |
| 122 | 53493 | -1 | GTTAATAATCATGCTCCGAA (GAG) | 2033 | 87 | 74 |
| 123 | 53495 | -1 | GAGTTAATAATCATGCTCCG (AAG) | 2034 | 82 | 86 |
| 124 | 53560 | 1 | GAGGTTATGTCATCTCCACA (GGG) | 2035 | 66 | 73 |
| 125 | 54056 | 1 | TCTTGCTTATTGCTTGACAA (CAG) | 2036 | 64 | 81 |
| 126 | 54511 | -1 | GAGCCATGATCACACCACTG (CGG) | 2037 | 69 | 84 |
| 127 | 54692 | -1 | AAGGCGGGTGAATCACTTGA (GGG) | 2038 | 81 | 65 |
| 128 | 54693 | -1 | CAAGGCGGGTGAATCACTTG (AGG) | 2039 | 84 | 62 |
| 129 | 55118 | 1 | ACCCTGGTCAATAGCCACAG (TGG) | 2040 | 70 | 72 |
| 130 | 55121 | -1 | AATGCAGGTATACTCCACTG (TGG) | 2041 | 79 | 79 |
| 131 | 55162 | 1 | ATACACTCTTGACAACCATA (GAG) | 2042 | 74 | 78 |
| 132 | 56004 | 1 | CCCCATTCTCAAATTCCAAG (CAG) | 2043 | 57 | 87 |
| 133 | 56439 | -1 | GATGTGTTCTTCAAGTAGCA (GAG) | 2044 | 66 | 86 |
| 134 | 57073 | 1 | GAGACTAATGTCGAACAACA (TGG) | 2045 | 81 | 67 |
| 135 | 57802 | -1 | TTTTAGCTAGAACCAGGGTG (GAG) | 2046 | 71 | 79 |
| 136 | 60122 | 1 | CTGACTAATGAAAACTCCTG (TGG) | 2047 | 62 | 70 |
| 137 | 60257 | -1 | TAGGCTGACAGGGTTACAGA (GGG) | 2048 | 66 | 70 |
| 138 | 60516 | -1 | ATGCTAGTGGTACCATGCAT (GGG) | 2049 | 81 | 61 |
| 139 | 60808 | -1 | GCCTCACTAGACTTTCAGTG (TAG) | 2050 | 76 | 79 |
| 140 | 61932 | -1 | GCACCCCAAAACAATTACCA (CAG) | 2051 | 66 | 85 |
| 141 | 62404 | 1 | TTAAGCCAAAGCCTAATCCA (CAG) | 2052 | 74 | 71 |
| 142 | 62737 | -1 | GCTGCATTATCCCCTAACAA (GAG) | 2053 | 81 | 94 |

TABLE 10-continued

Top-Scoring Guide-RNA Target Sites and PAM Sequences in SCN9A for Cas9 Nuclease

| Entry | Position | Strand | Guide-RNA target site (PAM) | SEQ ID NOs | Specificity score[50] | Efficiency score[28] |
|---|---|---|---|---|---|---|
| 143 | 63063 | -1 | CTATTTATAGAGCACAGGCA (GAG) | 2054 | 56 | 85 |
| 144 | 63147 | -1 | TGAGCTATAAGTATCAACAC (TGG) | 2055 | 80 | 63 |
| 145 | 63203 | -1 | CCAGGCACATTGTCAATAGG (CAG) | 2056 | 79 | 75 |
| 146 | 63236 | 1 | GTCACTCAAGAGCTCTAACG (GAG) | 2057 | 87 | 68 |
| 147 | 63239 | 1 | ACTCAAGAGCTCTAACGGAG (AGG) | 2058 | 89 | 68 |
| 148 | 63307 | 1 | TCTGTAGCCTATGGGCCAAA (GAG) | 2059 | 71 | 72 |
| 149 | 66208 | 1 | TTAGGATTGACTTGGCGATG (CGG) | 2060 | 84 | 61 |
| 150 | 66433 | 1 | GTTTGTAGTTCTCCTCGAAG (AGG) | 2061 | 84 | 62 |
| 151 | 66811 | -1 | AGGGAGACTTTATAAACCGG (AGG) | 2062 | 85 | 73 |
| 152 | 67111 | -1 | AGTGAGCCAAAATCGCGCCA (CGG) | 2063 | 95 | 69 |
| 153 | 67288 | -1 | AGGTGGGCAGAACACAACGT (CAG) | 2064 | 79 | 74 |
| 154 | 67480 | 1 | AAACTTACAATCATGGTCGA (AGG) | 2065 | 89 | 61 |
| 155 | 67959 | -1 | GGCTTTTTATTTGTATGCGG (CAG) | 2066 | 79 | 72 |
| 156 | 67997 | -1 | CATTTCTCACCGTATTCAGG (AGG) | 2067 | 82 | 62 |
| 157 | 67998 | -1 | GCATTTCTCACCGTATTCAG (GAG) | 2068 | 83 | 65 |
| 158 | 68003 | 1 | ACTTACCTCCTGAATACGGT (GAG) | 2069 | 90 | 67 |
| 159 | 68307 | -1 | GATTCCTCACTTACTAACCA (CGG) | 2070 | 75 | 73 |
| 160 | 68314 | 1 | ATTACCGTGGTTAGTAAGTG (AGG) | 2071 | 88 | 60 |
| 161 | 68419 | -1 | CCTAAGTTGAAGGAACGTCA (GAG) | 2072 | 83 | 63 |
| 162 | 68756 | -1 | CGCATCTATCAATGTCACCT (TGG) | 2073 | 80 | 62 |
| 163 | 69363 | -1 | GGAACAAAAGAGACGACAGT (GGG) | 2074 | 69 | 72 |
| 164 | 69460 | 1 | TATGACCATGAATAACCCAC (CGG) | 2075 | 68 | 71 |
| 165 | 69464 | -1 | CATTTTTGGTCCAGTCCGGT (GGG) | 2076 | 92 | 61 |
| 166 | 69955 | 1 | AGGGTGTGTCCATAACCCAA (CAG) | 2077 | 80 | 69 |
| 167 | 70069 | -1 | GTAAAAGTGTACCTAAACAC (AAG) | 2078 | 73 | 74 |
| 168 | 70165 | 1 | TCACTTTTCTTCGTGACCCG (TGG) | 2079 | 86 | 70 |
| 169 | 70656 | -1 | TTAATCTTAGGCTTAGTAAG (CAG) | 2080 | 69 | 83 |
| 170 | 70888 | 1 | GAGCCACCTAGACAATACAG (AAG) | 2081 | 74 | 74 |
| 171 | 70890 | 1 | GCCACCTAGACAATACAGAA (GGG) | 2082 | 69 | 75 |
| 172 | 71166 | 1 | TCACCACTACCTAATTAGAG (AAG) | 2083 | 80 | 79 |
| 173 | 71983 | 1 | GAGAGTGGGGTTAAACACCA (GGG) | 2084 | 73 | 76 |
| 174 | 72722 | 1 | TGTAGGGGCTTTGATCCAGT (CAG) | 2085 | 79 | 74 |
| 175 | 73080 | -1 | CTGCTAGATAGCTTAGAACC (AGG) | 2086 | 83 | 61 |
| 176 | 73091 | 1 | CCTGGTTCTAAGCTATCTAG (CAG) | 2087 | 82 | 62 |
| 177 | 73609 | 1 | TCATCTGTATGCACTCTCAG (AAG) | 2088 | 64 | 81 |
| 178 | 74688 | -1 | GCTGTCTCAGCCAATCACAG (CAG) | 2089 | 63 | 82 |
| 179 | 75558 | -1 | GCTTAAATGCCATCACCTCA (GAG) | 2090 | 64 | 83 |

TABLE 10-continued

Top-Scoring Guide-RNA Target Sites and PAM Sequences in SCN9A for Cas9 Nuclease

| Entry | Position | Strand | Guide-RNA target site (PAM) | SEQ ID NOs | Specificity score[50] | Efficiency score[28] |
|---|---|---|---|---|---|---|
| 180 | 76917 | -1 | TCTTTCCTCCTGTTTCGGTG (GAG) | 2091 | 74 | 72 |
| 181 | 77252 | 1 | GCCAGATTATGTGTAGACTG (TGG) | 2092 | 76 | 74 |
| 182 | 77679 | -1 | GTTTTAGCCCAATATAACCA (CAG) | 2093 | 71 | 87 |
| 183 | 77846 | -1 | GCACATGATACTCTACACTC (TGG) | 2094 | 81 | 62 |
| 184 | 77927 | -1 | GAAGAGTATATCCCCAACGA (AGG) | 2095 | 89 | 66 |
| 185 | 78181 | -1 | GGAATGCAGCATAACGGCAA (AGG) | 2096 | 90 | 61 |
| 186 | 78444 | -1 | CCATGTATATTAAATCTACA (GAG) | 2097 | 56 | 80 |
| 187 | 79522 | -1 | AACACTCCTGAACCTCGGGA (AGG) | 2098 | 85 | 61 |
| 188 | 80328 | 1 | TACTGAGTCTGCCTCTTCCG (GAG) | 2099 | 75 | 74 |
| 189 | 80331 | -1 | TATGTGGTACAATACTCCGG (AAG) | 2100 | 96 | 74 |
| 190 | 80539 | 1 | TAGGCTATACCACATAGCCT (AGG) | 2101 | 81 | 63 |
| 191 | 80545 | -1 | GTATAGGCTACCATACACCT (AGG) | 2102 | 88 | 69 |
| 192 | 80585 | 1 | GGTTTGTATAAGTGCACCCT (AGG) | 2103 | 82 | 60 |
| 193 | 80970 | -1 | GAAAATAAATTAAGGCAACG (TGG) | 2104 | 66 | 72 |
| 194 | 81615 | 1 | GTGCTCGAATTAACACAAGA (CAG) | 2105 | 83 | 66 |
| 195 | 81715 | 1 | TCTTCTTTCTGGAAAACGAA (GAG) | 2106 | 51 | 88 |
| 196 | 82630 | 1 | CGTGTGTAGTCAGTGTCCAG (AGG) | 2107 | 74 | 70 |
| 197 | 82993 | -1 | TGATATACTCAGGAAGGCGA (GAG) | 2108 | 74 | 72 |
| 198 | 83017 | -1 | GTACTTAACTAGGACCCCAT (GGG) | 2109 | 87 | 69 |
| 199 | 84026 | -1 | CCAAACCATGAAAACCCTAG (AAG) | 2110 | 71 | 74 |
| 200 | 84279 | -1 | GCATGGTAGTGGTACCCAAA (CAG) | 2111 | 81 | 79 |
| 201 | 85965 | 1 | GACAACTACCTAATGCATGC (AGG) | 2112 | 84 | 61 |
| 202 | 86012 | 1 | ATAGGTGGAGCAAACCACCA (TAG) | 2113 | 72 | 75 |
| 203 | 86606 | 1 | GGTGGGCAATGAGAACACAT (GGG) | 2114 | 61 | 74 |
| 204 | 86633 | 1 | GAGAAGATCATCACACACTG (GGG) | 2115 | 65 | 74 |
| 205 | 86724 | 1 | ATGGGTGCAGCAAACCACCA (TGG) | 2116 | 64 | 73 |
| 206 | 86730 | -1 | ACATGGGTAGACACGTGCCA (TGG) | 2117 | 83 | 75 |
| 207 | 87379 | -1 | TACGACAAAGAAGATCATGT (AGG) | 2118 | 67 | 72 |
| 208 | 87621 | 1 | CGGTTACAACAGAGGCTCTG (CGG) | 2119 | 63 | 71 |
| 209 | 87627 | -1 | AGAAGGCCAAGCATATACCG (CAG) | 2120 | 85 | 94 |
| 210 | 88070 | 1 | ACACACAATGGATTTCCCCA (GAG) | 2121 | 58 | 88 |
| 211 | 88144 | -1 | ACTGTTTTAGTCATACCCCA (TAG) | 2122 | 71 | 89 |
| 212 | 88422 | 1 | GGAGTCTAATGTATTAGGGG (AGG) | 2123 | 83 | 64 |
| 213 | 88874 | 1 | ACTACCTAGGGAATTCCCAG (AAG) | 2124 | 68 | 83 |
| 214 | 89604 | -1 | TATGCCCTTCGACACCAAGG (TGG) | 2125 | 78 | 72 |
| 215 | 89611 | 1 | GTTTCCACCTTGGTGTCGAA (GGG) | 2126 | 86 | 64 |
| 216 | 89689 | 1 | TGCTAAATGTGTATCACCCG (AGG) | 2127 | 88 | 68 |

TABLE 10-continued

Top-Scoring Guide-RNA Target Sites and PAM Sequences in SCN9A for Cas9 Nuclease

| Entry | Position | Strand | Guide-RNA target site (PAM) | SEQ ID NOs | Specificity score[50] | Efficiency score[28] |
|---|---|---|---|---|---|---|
| 217 | 89738 | 1 | TTTAGGGTAAGAGAACTCGG (GAG) | 2128 | 83 | 74 |
| 218 | 90216 | -1 | TTATAAGCAGGGAGGCCTGA (GAG) | 2129 | 54 | 81 |
| 219 | 90645 | -1 | GAAGTTGCCCAATACCAAAG (AGG) | 2130 | 70 | 72 |
| 220 | 90646 | -1 | AGAAGTTGCCCAATACCAAA (GAG) | 2131 | 64 | 82 |
| 221 | 91214 | 1 | TTTTCTGCAAGGCGAAGCAG (CAG) | 2132 | 72 | 76 |
| 222 | 91444 | 1 | TGCTGTGGACTGCAACGGTG (TGG) | 2133 | 82 | 68 |
| 223 | 91457 | -1 | CTGAGCGTCCATCAACCAGG (GAG) | 2134 | 81 | 69 |
| 224 | 92139 | 1 | GTAGCTCCTAAGTTGAAACG (GAG) | 2135 | 90 | 85 |
| 225 | 92140 | 1 | TAGCTCCTAAGTTGAAACGG (AGG) | 2136 | 87 | 72 |
| 226 | 92408 | 1 | AAGGTCTACGAGTCACTAAG (TGG) | 2137 | 88 | 64 |
| 227 | 93703 | 1 | GTAAGAGACAACCATTACAG (GAG) | 2138 | 67 | 81 |
| 228 | 94028 | -1 | ACTGGCTGTATATCATAGGA (GAG) | 2139 | 79 | 74 |
| 229 | 94038 | 1 | GCTCTCCTATGATATACAGC (CAG) | 2140 | 83 | 68 |
| 230 | 94204 | 1 | GCACGACCAATCAAATACAC (AAG) | 2141 | 87 | 70 |
| 231 | 95047 | 1 | TGTCATGGGACTAAAAACAC (AGG) | 2142 | 60 | 71 |
| 232 | 95431 | -1 | GCAAATCTGTACCACCAAGG (TGG) | 2143 | 73 | 73 |
| 233 | 95434 | -1 | TGTGCAAATCTGTACCACCA (AGG) | 2144 | 72 | 77 |
| 234 | 95600 | 1 | GGAACACCACCCAATGACTG (AGG) | 2145 | 74 | 74 |
| 235 | 95871 | 1 | ATAAAAGGTTACCATCTTGG (GAG) | 2146 | 61 | 82 |
| 236 | 96250 | -1 | CTATATGCCAGGCTAATAAG (CAG) | 2147 | 71 | 81 |
| 237 | 96762 | -1 | TGCTAACTCAGCGAGCACAT (GGG) | 2148 | 82 | 61 |
| 238 | 97850 | 1 | AGTTCTGCGATCATTCAGAC (TGG) | 2149 | 81 | 60 |
| 239 | 98726 | -1 | GGTTACCTAGAGCCCCTACT (GAG) | 2150 | 83 | 66 |
| 240 | 98747 | -1 | TGATGGCCAACACTAAGGTG (AGG) | 2151 | 69 | 73 |
| 241 | 99300 | -1 | TTACTAGTATAGCTTCAAGA (GAG) | 2152 | 64 | 88 |
| 242 | 99408 | -1 | ATAGAGGCTAGTCTTACACA (TGG) | 2153 | 72 | 72 |
| 243 | 99426 | 1 | TAAGACTAGCCTCTATAGCA (AGG) | 2154 | 80 | 63 |
| 244 | 99753 | -1 | CACGCGATGCTATAGGCCAG (TGG) | 2155 | 87 | 63 |
| 245 | 99765 | 1 | CACTGGCCTATAGCATCGCG (TGG) | 2156 | 97 | 66 |
| 246 | 99940 | -1 | ACTGTGACAAGTCAACGTGG (CAG) | 2157 | 81 | 77 |
| 247 | 99943 | -1 | CCAACTGTGACAAGTCAACG (TGG) | 2158 | 86 | 75 |
| 248 | 101373 | -1 | GTAGTTCCTCCATTAGTCAA (GAG) | 2159 | 74 | 92 |
| 249 | 101609 | 1 | TCTATATCAGGAAACTTGCG (AAG) | 2160 | 82 | 65 |
| 250 | 102970 | -1 | ACACGGATAAGACCACATGA (GAG) | 2161 | 72 | 74 |
| 251 | 103743 | -1 | TTACCAGATGAATCTTCAGG (AAG) | 2162 | 60 | 88 |
| 252 | 104091 | 1 | TGATGTATCCATGATCCGCA (AAG) | 2163 | 92 | 85 |
| 253 | 105545 | -1 | TACTCGCCCATAGATATCGA (GGG) | 2164 | 96 | 70 |

TABLE 10-continued

Top-Scoring Guide-RNA Target Sites and PAM Sequences in SCN9A for Cas9 Nuclease

| Entry | Position | Strand | Guide-RNA target site (PAM) | SEQ ID NOs | Specificity score[50] | Efficiency score[28] |
|---|---|---|---|---|---|---|
| 254 | 105546 | -1 | CTACTCGCCCATAGATATCG (AGG) | 2165 | 97 | 62 |
| 255 | 108599 | 1 | CTCAACTGGAAATCGTCCCA (GGG) | 2166 | 85 | 64 |
| 256 | 108829 | 1 | AGCTAACATGATACTAACCA (GGG) | 2167 | 76 | 79 |
| 257 | 109542 | 1 | ATAAAGCTATAGTAACCAAA (CAG) | 2168 | 58 | 93 |
| 258 | 110187 | 1 | CTCAACATCACTAATCACCA (GGG) | 2169 | 69 | 72 |
| 259 | 110646 | 1 | GGCAACATGAATGAACCTGG (AGG) | 2170 | 65 | 78 |
| 260 | 110720 | -1 | CTACTTCTATGACAACCCTT (TAG) | 2171 | 71 | 72 |
| 261 | 110756 | 1 | AGTAGAATAGTGGTTATCGG (AGG) | 2172 | 87 | 66 |
| 262 | 110856 | -1 | CTAGTCATCCAACGATTCAA (TAG) | 2173 | 91 | 73 |
| 263 | 112186 | 1 | TCTCTGGCCCGGTACTCACG (TAG) | 2174 | 92 | 61 |
| 264 | 112189 | -1 | ACACAGGGAGAAAACTACGT (GAG) | 2175 | 72 | 71 |
| 265 | 112238 | -1 | GTCCAAATCCAATATAACTG (GGG) | 2176 | 68 | 74 |
| 266 | 112970 | 1 | TGCCACGATAAGGCCCAAAG (AGG) | 2177 | 80 | 68 |
| 267 | 113933 | -1 | AATTTCATCAACAAGCCAGG (GAG) | 2178 | 56 | 83 |
| 268 | 114417 | 1 | CCACAGATCAGCAGTCCACG (TGG) | 2179 | 77 | 73 |
| 269 | 114563 | 1 | GTAGAGAAAGAAATAGAACG (AAG) | 2180 | 51 | 94 |
| 270 | 114615 | 1 | GGAAGGGCAAAACTTTCCCA (GAG) | 2181 | 52 | 86 |
| 271 | 119671 | 1 | AAGATTGTAGAGACCTCAAG (GGG) | 2182 | 60 | 76 |
| 272 | 124929 | -1 | ACAGATGGTGATGACCAATG (GGG) | 2183 | 72 | 77 |
| 273 | 126886 | 1 | GGGGCCGTGCAAATATATGG (AGG) | 2184 | 90 | 63 |
| 274 | 126887 | 1 | GGGCCGTGCAAATATATGGA (GGG) | 2185 | 82 | 63 |
| 275 | 127078 | -1 | CCTCAAGTGATCGCCCACCT (CGG) | 2186 | 87 | 60 |
| 276 | 127540 | 1 | GGGAGCTTAGACTAGTATGG (TAG) | 2187 | 89 | 68 |
| 277 | 131325 | 1 | AGAGTTGCACAGTAGCCCAA (TAG) | 2188 | 70 | 82 |
| 278 | 131352 | -1 | TCTGGATTATTCTCTCTGGA (CAG) | 2189 | 55 | 83 |
| 279 | 131411 | 1 | AGAGATGCACAATAGCCCGA (CAG) | 2190 | 86 | 91 |
| 280 | 131432 | -1 | CTATTCCGTTTGAATAGCAG (AAG) | 2191 | 72 | 85 |
| 281 | 131938 | -1 | AGGATCCCAGGACTACCAGG (TGG) | 2192 | 68 | 74 |
| 282 | 132160 | -1 | GATGTCTCCACGGTACATGG (AGG) | 2193 | 84 | 72 |
| 283 | 132164 | 1 | AACTTATCCTCCATGTACCG (TGG) | 2194 | 85 | 66 |
| 284 | 132166 | 1 | CTTATCCTCCATGTACCGTG (GAG) | 2195 | 88 | 68 |
| 285 | 132402 | -1 | AGTTTGGGTGGAATTCCAGG (CAG) | 2196 | 51 | 91 |
| 286 | 132545 | -1 | ACTAAAGTGACAGATAGTCA (GGG) | 2197 | 64 | 70 |
| 287 | 135192 | 1 | TCACTGCAAACACAACCCTG (AGG) | 2198 | 65 | 77 |
| 288 | 135662 | -1 | TAGGTAAACACGTGTCATGG (GGG) | 2199 | 77 | 71 |
| 289 | 135663 | -1 | ATAGGTAAACACGTGTCATG (GGG) | 2200 | 83 | 64 |
| 290 | 138647 | 1 | GTTTACATATTATTTTAACG (AAG) | 2201 | 54 | 90 |

TABLE 10-continued

Top-Scoring Guide-RNA Target Sites and PAM Sequences in SCN9A for Cas9 Nuclease

| Entry | Position | Strand | Guide-RNA target site (PAM) | SEQ ID NOs | Specificity score[50] | Efficiency score[28] |
|---|---|---|---|---|---|---|
| 291 | 140378 | 1 | GGTCTCAAAACTGAAAACGT (TGG) | 2202 | 68 | 71 |
| 292 | 140459 | -1 | ATTTGCCACATCCAACCCCA (GAG) | 2203 | 51 | 87 |
| 293 | 140907 | 1 | TTAAAGTTCTGGAAGCTGGG (AAG) | 2204 | 52 | 86 |
| 294 | 141052 | -1 | GAGTGAGTTAGATATCACAA (GAG) | 2205 | 71 | 75 |
| 295 | 144206 | 1 | AAAAAGACGGACGGATCATG (AGG) | 2206 | 85 | 62 |
| 296 | 144318 | 1 | TGTAGTCTCAGCTACTAGGG (AGG) | 2207 | 60 | 74 |
| 297 | 145243 | 1 | GTACAGTGGTACATAGACCC (CGG) | 2208 | 90 | 72 |
| 298 | 145249 | -1 | TACTCACTCTTTGGGGACCG (GGG) | 2209 | 84 | 64 |
| 299 | 145337 | 1 | CAGTAGGGAGTGGCTATCCG (GGG) | 2210 | 87 | 66 |
| 300 | 145363 | 1 | TCTGGGAAGACATCACAAGG (AGG) | 2211 | 60 | 76 |
| 301 | 145431 | 1 | AGGCAGATAGGCATTCAAGG (CAG) | 2212 | 56 | 85 |
| 302 | 145518 | -1 | CCCTACTATGTTTATCACGT (AGG) | 2213 | 92 | 65 |
| 303 | 145524 | 1 | GAGTGCCTACGTGATAAACA (TAG) | 2214 | 84 | 75 |
| 304 | 145883 | 1 | AGAGTTGAATAGTTGCAACG (GAG) | 2215 | 80 | 64 |
| 305 | 148450 | -1 | ACCACTAGGCTACTATCAGG (TGG) | 2216 | 88 | 63 |
| 306 | 148460 | 1 | TCCACCTGATAGTAGCCTAG (TGG) | 2217 | 88 | 74 |
| 307 | 148475 | 1 | CCTAGTGGTTGTGAGTACAG (CAG) | 2218 | 76 | 81 |
| 308 | 149832 | -1 | TCAGGAACCATATCTTACGT (TGG) | 2219 | 87 | 66 |
| 309 | 150045 | -1 | TCTAACCTCCAAAAGTGTGA (GAG) | 2220 | 67 | 82 |
| 310 | 150239 | -1 | ACTGGCATCCTTACTAGTAG (AGG) | 2221 | 84 | 61 |
| 311 | 152488 | 1 | CCATTTTAGTTACTTCACCG (AAG) | 2222 | 83 | 86 |
| 312 | 153443 | -1 | GGAGAATCACTTGAACCAGG (GAG) | 2223 | 54 | 88 |
| 313 | 154133 | -1 | GGGGTGCCAAGAATACACAA (TAG) | 2224 | 75 | 76 |
| 314 | 154336 | 1 | TTATAATCCCAGCAACTCGG (GAG) | 2225 | 80 | 68 |
| 315 | 154500 | 1 | GGAGGATCACTGAAGCCCAA (GAG) | 2226 | 59 | 83 |
| 316 | 154992 | 1 | ATTGTTAGTGTATAGAAACG (CAG) | 2227 | 76 | 76 |
| 317 | 155184 | -1 | ACAGCACTAGAAGTCCTAGC (CAG) | 2228 | 81 | 68 |
| 318 | 155293 | 1 | ATTGAATACGATGTTAGCTG (TGG) | 2229 | 80 | 60 |
| 319 | 155374 | 1 | GCTACTATAACAGAATACCA (CAG) | 2230 | 66 | 91 |
| 320 | 155448 | 1 | ATGGAAAGTTCATGACTGAG (GGG) | 2231 | 62 | 70 |
| 321 | 155658 | -1 | GCAATTGTGACAGAATTGGG (AGG) | 2232 | 63 | 74 |
| 322 | 155913 | -1 | CATGTACTACGACCAAGTGG (GAG) | 2233 | 84 | 81 |
| 323 | 155915 | -1 | ATCATGTACTACGACCAAGT (GGG) | 2234 | 92 | 69 |
| 324 | 155916 | -1 | GATCATGTACTACGACCAAG (TGG) | 2235 | 92 | 63 |
| 325 | 155918 | 1 | GGACAACTCCCACTTGGTCG (TAG) | 2236 | 88 | 62 |
| 326 | 156439 | -1 | AAGGGTAACAACACACACTG (GGG) | 2237 | 67 | 74 |
| 327 | 157217 | -1 | CTATCAACAGAGTAAGCAGA (CAG) | 2238 | 54 | 81 |

TABLE 10-continued

Top-Scoring Guide-RNA Target Sites and PAM Sequences in SCN9A for Cas9 Nuclease

| Entry | Position | Strand | Guide-RNA target site (PAM) | SEQ ID NOs | Specificity score[50] | Efficiency score[28] |
|---|---|---|---|---|---|---|
| 328 | 157656 | -1 | ATGGGTGCCGCACACCAACA (TGG) | 2239 | 82 | 65 |
| 329 | 159943 | 1 | GCATCCCTCAGATAAATCCC (AAG) | 2240 | 71 | 82 |
| 330 | 160831 | -1 | TTGAACAACTCATAATTACG (TGG) | 2241 | 83 | 70 |
| 331 | 161670 | 1 | GTAGCCTAATGGTTTCCATG (GGG) | 2242 | 68 | 77 |
| 332 | 161744 | -1 | CAAGTACAAAAAACGATGGG (GGG) | 2243 | 85 | 66 |
| 333 | 162012 | 1 | ATAGTTTCTCAACCCTTGGG (AAG) | 2244 | 70 | 77 |
| 334 | 162135 | -1 | GAAAAACTCATGCACACCAG (AGG) | 2245 | 63 | 71 |
| 335 | 163457 | -1 | TGCAGCAACACCATAACAGT (AGG) | 2246 | 78 | 70 |
| 336 | 163882 | -1 | GTAACCAAAAGAGAGCAATG (GGG) | 2247 | 53 | 82 |
| 337 | 164242 | -1 | ATTGCCTCATGATAACCACA (AGG) | 2248 | 64 | 72 |
| 338 | 164558 | -1 | CATGGTAAAGAGCAACACAA (GAG) | 2249 | 53 | 83 |
| 339 | 164789 | 1 | GCTCTTTTAAAGTTTCCACT (GAG) | 2250 | 55 | 84 |
| 340 | 166597 | -1 | TGAAGTTTAGCAAAGTACCA (GAG) | 2251 | 61 | 80 |
| 341 | 166686 | -1 | AAAGGGATAAAAGAAATCCG (CAG) | 2252 | 56 | 83 |
| 342 | 168072 | -1 | GCATGCCAAGAACTTGACAG (AAG) | 2253 | 62 | 95 |
| 343 | 169562 | 1 | CTTATGAGTGAGAACATGCA (GAG) | 2254 | 57 | 80 |
| 344 | 170590 | -1 | CCTCACAAAAACAAGCAACG (GGG) | 2255 | 72 | 73 |
| 345 | 175111 | -1 | TCAAGTGATTTCGCCCACCT (CGG) | 2256 | 85 | 64 |
| 346 | 180157 | -1 | GTAGGAACACTTGAAGCCAG (GAG) | 2257 | 61 | 84 |

*Searching was based on WT Cas9 PAMs, 347 solutions out of ~34,500 possible guide-RNA sequences are shown.

TABLE 11

Top-Scoring Guide-RNA Target Sites and PAM Sequences in SCN9A for Programmed Cas9-Nickase Pairs

| Pair | Position | Strand | Guide-RNA target site (PAM) | SEQ ID NOs | Specificity score[50] | Efficiency score[28] |
|---|---|---|---|---|---|---|
| 1 | 6112 | 1 | CAGGAGTTCTAGATCAGCCT (GGG) | 2258 | 66 | 60 |
|   | 6050 | -1 | CCAAAGTGATGGGATTGCAG (GGG) | 2259 | 62 | 70 |
| 2 | 14921 | 1 | ATAAGAACTGAGCTTTAGAG (AAG) | 2260 | 55 | 84 |
|   | 14896 | -1 | AGTTCTTATATAGCAAACCG (GAG) | 2261 | 88 | 82 |
| 3 | 24369 | 1 | AAGACTGATGAATCCAGCCA (GGG) | 2262 | 61 | 68 |
|   | 24306 | -1 | ATCCAAGTCATTAGTCTTGG (GGG) | 2263 | 74 | 64 |
| 4 | 26796 | 1 | ATAAGATGGTCACAGCTTGG (GGG) | 2264 | 63 | 74 |
|   | 26751 | -1 | CTCCCATATTTAGCCCAATG (GGG) | 2265 | 76 | 68 |
| 5 | 26974 | 1 | TCCTGCCTCAGCCTTCCGAG (GAG) | 2266 | 55 | 84 |
|   | 26943 | -1 | GGAGAATCGCTTGAACCCAG (GAG) | 2267 | 59 | 75 |
| 6 | 27276 | 1 | TTGAGTCCTAGATAGGTGGG (TGG) | 2268 | 71 | 61 |
|   | 27249 | -1 | GACTCAAGATCCTAGATAGG (TGG) | 2269 | 79 | 61 |
| 7 | 27277 | 1 | TGAGTCCTAGATAGGTGGGT (GGG) | 2270 | 74 | 64 |
|   | 27249 | -1 | GACTCAAGATCCTAGATAGG (TGG) | 2271 | 79 | 61 |
| 8 | 27313 | 1 | AAATTGGGCTGGGACCACTT (AGG) | 2272 | 78 | 60 |
|   | 27249 | -1 | GACTCAAGATCCTAGATAGG (TGG) | 2273 | 79 | 61 |

TABLE 11-continued

Top-Scoring Guide-RNA Target Sites and PAM Sequences in SCN9A for Programmed Cas9-Nickase Pairs

| Pair | Position | Strand | Guide-RNA target site (PAM) | SEQ ID NOs | Specificity score[50] | Efficiency score[28] |
|---|---|---|---|---|---|---|
| 9 | 28567 | 1 | TGCATGAAAACCTATCCCCT(GGG) | 2274 | 77 | 66 |
|  | 28522 | -1 | TGGGAGATCAACATGCCTAG(TGG) | 2275 | 69 | 73 |
| 10 | 29897 | 1 | AATTACCTCCCACAGCAGCA(CAG) | 2276 | 50 | 76 |
|  | 29862 | -1 | GTATTACCACTTCGTGAAAA(GAG) | 2277 | 85 | 62 |
| 11 | 29916 | 1 | ACAGGTTACTCAAAAGCCCA(GAG) | 2278 | 60 | 62 |
|  | 29862 | -1 | GTATTACCACTTCGTGAAAA(GAG) | 2279 | 85 | 62 |
| 12 | 29919 | 1 | GGTTACTCAAAAGCCCAGAG(GAG) | 2280 | 58 | 73 |
|  | 29862 | -1 | GTATTACCACTTCGTGAAAA(GAG) | 2281 | 85 | 62 |
| 13 | 30917 | 1 | TAGATACCCATCTTATACAC(AGG) | 2282 | 82 | 60 |
|  | 30869 | -1 | GTCTTTAACTATCATCCATG(TGG) | 2283 | 67 | 67 |
| 14 | 30917 | 1 | TAGATACCCATCTTATACAC(AGG) | 2284 | 82 | 60 |
|  | 30864 | -1 | TAACTATCATCCATGTGGAA(GGG) | 2285 | 62 | 60 |
| 15 | 31268 | 1 | TTTGCACAAAGGATTGTAGG(TGG) | 2286 | 63 | 64 |
|  | 31215 | -1 | CAAGATACCAAACTAAGAGG(TGG) | 2287 | 62 | 63 |
| 16 | 32326 | 1 | TAGCTGAGATCCACTCCCCT(CGG) | 2288 | 72 | 69 |
|  | 32274 | -1 | GATGTTTGCTTGAGCCCCTG(GGG) | 2289 | 66 | 65 |
| 17 | 32400 | 1 | CTTTTTCAATGAGGAAACCG(TGG) | 2290 | 64 | 62 |
|  | 32338 | -1 | TATAATCCCAGCACTTTGGG(AGG) | 2291 | 8 | 64 |
| 18 | 36029 | 1 | AATAGGAGACATAGTTCCTG(AGG) | 2292 | 61 | 68 |
|  | 35994 | -1 | CACTGGTGAGGAAGTTACAC(GGG) | 2293 | 79 | 63 |
| 19 | 36029 | 1 | AATAGGAGACATAGTTCCTG(AGG) | 2294 | 61 | 68 |
|  | 35976 | -1 | ACGGGTAGTCTGTTAGAAAG(AGG) | 2295 | 67 | 60 |
| 20 | 39372 | 1 | TTAGAGCCAAAGGAGCAAGT(AAG) | 2296 | 58 | 62 |
|  | 39329 | -1 | TTACACTGTAAACGGCCTGA(GAG) | 2297 | 86 | 70 |
| 21 | 39469 | 1 | CTCAGCTTAATCGATTTTGG(GGG) | 2298 | 77 | 60 |
|  | 39418 | -1 | TAGACCACAATTTCACCTGG(AGG) | 2299 | 66 | 64 |
| 22 | 39847 | 1 | TAAGGGAACACCAAAAGCAC(AGG) | 2300 | 62 | 61 |
|  | 39815 | -1 | TAGCCAAACCTGCTAGAAAG(AGG) | 2301 | 61 | 64 |
| 23 | 40326 | 1 | CTATGCTTCTGAAAGTTAGC(AAG) | 2302 | 58 | 61 |
|  | 40298 | -1 | GCATAGTTACTGGAGTGAGG(CAG) | 2303 | 61 | 75 |
| 24 | 40326 | 1 | CTATGCTTCTGAAAGTTAGC(AAG) | 2304 | 58 | 61 |
|  | 40298 | -1 | GCATAGTTACTGGAGTGAGG(CAG) | 2305 | 61 | 75 |
| 25 | 43824 | 1 | TGTACATAGACCCAGCACAA(GGG) | 2306 | 71 | 76 |
|  | 43791 | -1 | AGCTATAGTAGAATCCTGTG(TGG) | 2307 | 76 | 75 |
| 26 | 44028 | 1 | TCCATCACCACTACACACAA(TGG) | 2308 | 60 | 60 |
|  | 43991 | -1 | CAGAGCCTTGACACCTGCCG(TGG) | 2309 | 70 | 68 |
| 27 | 45061 | 1 | GATCTGTTTATAGGCCACAG(TGG) | 2310 | 61 | 66 |
|  | 45014 | -1 | TCTGTGGCTTATACAACTGG(GGG) | 2311 | 75 | 70 |
| 28 | 45061 | 1 | GATCTGTTTATAGGCCACAG(TGG) | 2312 | 61 | 66 |
|  | 45015 | -1 | ATCTGTGGCTTATACAACTG(GGG) | 2313 | 65 | 64 |
| 29 | 45113 | 1 | CAGTGACAGATACTGGTCCA(TGG) | 2314 | 66 | 60 |
|  | 45064 | -1 | ACCCCTGATCTAACCCACTG(TGG) | 2315 | 73 | 68 |
| 30 | 45255 | 1 | TATTGTGAACTGCACATACG(AGG) | 2316 | 81 | 65 |
|  | 45194 | -1 | GCCAAGGCTGATCTAACAGG(AGG) | 2317 | 75 | 69 |
| 31 | 45255 | 1 | TATTGTGAACTGCACATACG(AGG) | 2318 | 81 | 65 |
|  | 45210 | -1 | TCTCTGAGAGTCTAATGCCA(AGG) | 2319 | 62 | 64 |
| 32 | 45256 | 1 | ATTGTGAACTGCACATACGA(GGG) | 2320 | 88 | 71 |
|  | 45194 | -1 | GCCAAGGCTGATCTAACAGG(AGG) | 2321 | 75 | 69 |

TABLE 11-continued

Top-Scoring Guide-RNA Target Sites and PAM Sequences in SCN9A for Programmed Cas9-Nickase Pairs

| Pair | Position | Strand | Guide-RNA target site (PAM) | SEQ ID NOs | Specificity score[50] | Efficiency score[28] |
|---|---|---|---|---|---|---|
| 33 | 45256 | 1 | ATTGTGAACTGCACATACGA(GGG) | 2322 | 88 | 71 |
|  | 45210 | -1 | TCTCTGAGAGTCTAATGCCA(AGG) | 2323 | 62 | 64 |
| 34 | 50918 | 1 | AATGGTGCAGATAGTAAGGA(CAG) | 2324 | 65 | 60 |
|  | 50879 | -1 | ATAAATCTATTCCAAGACAA(AAG) | 2325 | 51 | 73 |
| 35 | 53558 | 1 | GAGAGGTTATGTCATCTCCA(CAG) | 2326 | 64 | 69 |
|  | 53495 | -1 | GAGTTAATAATCATGCTCCG(AAG) | 2327 | 82 | 86 |
| 36 | 57832 | 1 | AAAATGGACATGGATACCCT(AGG) | 2328 | 70 | 65 |
|  | 57804 | -1 | CATTTTAGCTAGAACCAGGG(TGG) | 2329 | 71 | 68 |
| 37 | 57832 | 1 | AAAATGGACATGGATACCCT(AGG) | 2330 | 70 | 65 |
|  | 57807 | -1 | GTCCATTTTAGCTAGAACCA(GGG) | 2331 | 71 | 65 |
| 38 | 63236 | 1 | GTCACTCAAGAGCTCTAACG(GAG) | 2332 | 87 | 68 |
|  | 63203 | -1 | CCAGGCACATTGTCAATAGG(CAG) | 2333 | 79 | 75 |
| 39 | 63246 | 1 | AGCTCTAACGGAGAGGTACA(AGG) | 2334 | 78 | 62 |
|  | 63221 | -1 | GTTAGAGCTCTTGAGTGACC(AGG) | 2335 | 75 | 61 |
| 40 | 63247 | 1 | GCTCTAACGGAGAGGTACAA(GGG) | 2336 | 78 | 64 |
|  | 63221 | -1 | GTTAGAGCTCTTGAGTGACC(AGG) | 2337 | 75 | 61 |
| 41 | 66136 | 1 | TTTGGGTTACTGTAGCCTTG(TAG) | 2338 | 67 | 68 |
|  | 66100 | -1 | GCATGGTACTGGTACCAAAA(CAG) | 2339 | 74 | 63 |
| 42 | 68003 | 1 | ACTTACCTCCTGAATACGGT(GAG) | 2340 | 90 | 67 |
|  | 67959 | -1 | GGCTTTTTATTTGTATGCGG(CAG) | 2341 | 79 | 72 |
| 43 | 70978 | 1 | TTTTGAGGTCACATATGATG(GGG) | 2342 | 63 | 66 |
|  | 70933 | -1 | GATGGAAAAGAGGTTAGGCA(GGG) | 2343 | 64 | 67 |
| 44 | 76923 | 1 | GACAGCTCCACCGAAACAGG(AGG) | 2344 | 76 | 65 |
|  | 76882 | -1 | TTTACTCTTTCACTTTCACG(AGG) | 2345 | 61 | 62 |
| 45 | 79521 | 1 | TACCAGGCCCATCCTTCCCG(AGG) | 2346 | 68 | 64 |
|  | 79497 | -1 | GGGCCTGGTAGAGTGAGTAT(GGG) | 2347 | 77 | 68 |
| 46 | 80585 | 1 | GGTTTGTATAAGTGCACCCT(AGG) | 2348 | 82 | 60 |
|  | 80545 | -1 | GTATAGGCTACCATACACCT(AGG) | 2349 | 88 | 69 |
| 47 | 80599 | 1 | CACCCTAGGATGTTTGCACA(AGG) | 2350 | 73 | 60 |
|  | 80545 | -1 | GTATAGGCTACCATACACCT(AGG) | 2351 | 88 | 69 |
| 48 | 89635 | 1 | ATAGGCGAGCACATGAAAAG(AGG) | 2352 | 73 | 70 |
|  | 89604 | -1 | TATGCCCTTCGACACCAAGG(TGG) | 2353 | 78 | 72 |
| 49 | 89689 | 1 | TGCTAAATGTGTATCACCCG(AGG) | 2354 | 88 | 68 |
|  | 89654 | -1 | TTTGGGTGGTACCTGATTGG(GGG) | 2355 | 77 | 66 |
| 50 | 89689 | 1 | TGCTAAATGTGTATCACCCG(AGG) | 2356 | 88 | 68 |
|  | 89655 | -1 | ATTTGGGTGGTACCTGATTG(GGG) | 2357 | 76 | 60 |
| 51 | 90246 | 1 | ATAATTCTGCACAAATCCCC(AAG) | 2358 | 64 | 66 |
|  | 90216 | -1 | TTATAAGCAGGGAGGCCTGA(GAG) | 2359 | 54 | 81 |
| 52 | 91383 | 1 | GTAACATCAGCCAAGCCAGT(AGG) | 2360 | 63 | 69 |
|  | 91353 | -1 | TTACTGCTGCGTCGCTCCTG(GGG) | 2361 | 76 | 69 |
| 53 | 91402 | 1 | TAGGTCCCCACCAATGCTGC(CGG) | 2362 | 75 | 65 |
|  | 91353 | -1 | TTACTGCTGCGTCGCTCCTG(GGG) | 2363 | 76 | 69 |
| 54 | 91444 | 1 | TGCTGTGGACTGCAACGGTG(TGG) | 2364 | 82 | 68 |
|  | 91396 | -1 | GTTCACCGGCAGCATTGGTG(GGG) | 2365 | 78 | 62 |
| 55 | 91444 | 1 | TGCTGTGGACTGCAACGGTG(TGG) | 2366 | 82 | 68 |
|  | 91382 | -1 | TTGGTGGGGACCTACTGGCT(TGG) | 2367 | 75 | 62 |
| 56 | 92524 | 1 | TGCATTACCAATATCAGCAA(GGG) | 2368 | 63 | 64 |
|  | 92494 | -1 | TGCAGCATAGCATAGTGAGT(GGG) | 2369 | 73 | 65 |

TABLE 11-continued

Top-Scoring Guide-RNA Target Sites and PAM Sequences in SCN9A for Programmed Cas9-Nickase Pairs

| Pair | Position | Strand | Guide-RNA target site (PAM) | SEQ ID NOs | Specificity score[50] | Efficiency score[28] |
|---|---|---|---|---|---|---|
| 57 | 92524 | 1 | TGCATTACCAATATCAGCAA (GGG) | 2370 | 63 | 64 |
|  | 92495 | -1 | ATGCAGCATAGCATAGTGAG (TGG) | 2371 | 68 | 66 |
| 58 | 93703 | 1 | GTAAGAGACAACCATTACAG (GAG) | 2372 | 67 | 81 |
|  | 93663 | -1 | GGAAGACCTCATGAACTGAG (CAG) | 2373 | 61 | 70 |
| 59 | 94847 | 1 | CCCCCACATTCCCATTGTGG (GGG) | 2374 | 66 | 64 |
|  | 94784 | -1 | GACCTGGGGCATATTGTCAG (GGG) | 2375 | 77 | 69 |
| 60 | 94847 | 1 | CCCCCACATTCCCATTGTGG (GGG) | 2376 | 66 | 64 |
|  | 94816 | -1 | GGGGTGAAGTGTTAGACCCA (GGG) | 2377 | 73 | 67 |
| 61 | 94847 | 1 | CCCCCACATTCCCATTGTGG (GGG) | 2378 | 66 | 64 |
|  | 94806 | -1 | GTTAGACCCAGGGACCAGGT (GGG) | 2379 | 62 | 69 |
| 62 | 99426 | 1 | TAAGACTAGCCTCTATAGCA (AGG) | 2380 | 80 | 63 |
|  | 99395 | -1 | TTACACATGGCTATAAGGTG (CGG) | 2381 | 76 | 62 |
| 63 | 99993 | 1 | TCTCTCATCAGGTATCCAGA (AGG) | 2382 | 70 | 69 |
|  | 99943 | -1 | CCAACTGTGACAAGTCAACG (TGG) | 2383 | 86 | 75 |
| 64 | 111569 | 1 | GTTATCTCAAAGGTACCCAT (GAG) | 2384 | 74 | 71 |
|  | 111513 | -1 | CACTGACTATCTCTTCAGAG (AAG) | 2385 | 59 | 67 |
| 65 | 112933 | 1 | GGAGAAGGGTATAACCTTGG (GGG) | 2386 | 72 | 66 |
|  | 112878 | -1 | CCTGCATCCAATGAATGGTG (TGG) | 2387 | 70 | 68 |
| 66 | 131392 | 1 | AGACCACCGTCCAGAAAGAA (GAG) | 2388 | 55 | 69 |
|  | 131349 | -1 | GGATTATTCTCTCTGGACAG (TAG) | 2389 | 61 | 70 |
| 67 | 131392 | 1 | AGACCACCGTCCAGAAAGAA (GAG) | 2390 | 55 | 69 |
|  | 131352 | -1 | TCTGGATTATTCTCTCTGGA (CAG) | 2391 | 55 | 83 |
| 68 | 131411 | 1 | AGAGATGCACAATAGCCCGA (CAG) | 2392 | 86 | 91 |
|  | 131349 | -1 | GGATTATTCTCTCTGGACAG (TAG) | 2393 | 61 | 70 |
| 69 | 131411 | 1 | AGAGATGCACAATAGCCCGA (CAG) | 2394 | 86 | 91 |
|  | 131352 | -1 | TCTGGATTATTCTCTCTGGA (CAG) | 2395 | 55 | 83 |
| 70 | 134360 | 1 | TCAGGGTCTAGAAAGACGAA (CAG) | 2396 | 68 | 69 |
|  | 134315 | -1 | TACGTTTCTGAAATTGCAAG (CAG) | 2397 | 55 | 78 |
| 71 | 135192 | 1 | TCACTGCAAACACAACCCTG (AGG) | 2398 | 65 | 77 |
|  | 135158 | -1 | GCAACCTTGAGACATGAGGT (AGG) | 2399 | 70 | 64 |
| 72 | 135192 | 1 | TCACTGCAAACACAACCCTG (AGG) | 2400 | 65 | 77 |
|  | 135162 | -1 | GTGAGCAACCTTGAGACATG (AGG) | 2401 | 69 | 67 |
| 73 | 138647 | 1 | GTTTACATATTATTTTAACG (AAG) | 2402 | 54 | 90 |
|  | 138593 | -1 | TCCATCATCCAAGTATTCAA (CAG) | 2403 | 65 | 67 |
| 74 | 140490 | 1 | AATCATTGTAACAAGCCCTA (CAG) | 2404 | 71 | 64 |
|  | 140459 | -1 | ATTTGCCACATCCAACCCCA (GAG) | 2405 | 51 | 87 |
| 75 | 140966 | 1 | TTGCTGGTGGGCACACCAGA (GAG) | 2406 | 63 | 68 |
|  | 140940 | -1 | ACCAGCAAGAAAGTTCCCAC (CAG) | 2407 | 68 | 67 |
| 76 | 141112 | 1 | CTATATTCCATTCATGAAGG (CAG) | 2408 | 56 | 64 |
|  | 141052 | -1 | GAGTGAGTTAGATATCACAA (GAG) | 2409 | 71 | 75 |
| 77 | 144318 | 1 | TGTAGTCTCAGCTACTAGGG (AGG) | 2410 | 60 | 74 |
|  | 144285 | -1 | AGGTGAGCACCACTATGCCC (GGG) | 2411 | 78 | 62 |
| 78 | 156887 | 1 | CACTCCCATCAACAGTGTGT (AGG) | 2412 | 72 | 69 |
|  | 156842 | -1 | AACCATAATGGAAGACTGTG (TGG) | 2413 | 60 | 64 |
| 79 | 161670 | 1 | GTAGCCTAATGGTTTCCATG (GGG) | 2414 | 68 | 77 |
|  | 161635 | -1 | CGTTTTCCAGCCGCTCCCTG (TGG) | 2415 | 62 | 63 |
| 80 | 163858 | 1 | CATGACCCTGTAGATACTGA (AGG) | 2416 | 68 | 65 |
|  | 163829 | -1 | TCATGGTTTCAGAACCCCAA (GGG) | 2417 | 65 | 70 |

TABLE 11-continued

Top-Scoring Guide-RNA Target Sites and PAM Sequences in SCN9A for Programmed Cas9-Nickase Pairs

| Pair | Position | Strand | Guide-RNA target site (PAM) | SEQ ID NOs | Specificity score[50] | Efficiency score[28] |
|---|---|---|---|---|---|---|
| 81 | 168112 | 1 | TTTCAGTCCCCATTAATGAA (CAG) | 2418 | 59 | 64 |
|    | 168072 | -1 | GCATGCCAAGAACTTGACAG (AAG) | 2419 | 62 | 95 |
| 82 | 168112 | 1 | TTTCAGTCCCCATTAATGAA (CAG) | 2420 | 59 | 64 |
|    | 168075 | -1 | ACAGCATGCCAAGAACTTGA (CAG) | 2421 | 58 | 72 |
| 83 | 170725 | 1 | TTTTGGTTACTGTAGCCTTG (TAG) | 2422 | 65 | 63 |
|    | 170689 | -1 | GCATGGTACTGGTACCAAAA (CAG) | 2423 | 74 | 63 |
| 84 | 180194 | 1 | CATGACCTGCCAACATGCTG (GGG) | 2424 | 65 | 63 |
|    | 180140 | -1 | CAGGAGTTTGAGACTAGCCT (GGG) | 2425 | 63 | 69 |

*Searching was based on WT Cas9 PAMs, 84 solutions out of ~37,500 possible pairs shown.

Nucleobase Editors for Use in the Invention

The methods of editing ion channel-encoding genes in neurons (e.g., DRG neurons) for pain suppression are enabled by the use of the nucleobase editors. As described herein, a nucleobase editor is a fusion protein comprising: (i) a programmable DNA binding protein domain; and (ii) a deaminase domain. Any programmable DNA binding domain may be used in the based editors.

In some embodiments, the programmable DNA binding protein domain comprises the DNA binding domain of a zinc finger nuclease (ZFN) or a transcription activator-like effector domain (TALE). In some embodiments, the programmable DNA binding protein domain may be programmed by a guide nucleotide sequence and is thus referred as a "guide nucleotide sequence-programmable DNA binding-protein domain." In some embodiments, the guide nucleotide sequence-programmable DNA binding protein is a nuclease inactive Cas9, or dCas9. A dCas9 as used herein, encompasses a Cas9 that is completely inactive with respect to its nuclease activity, or partially inactive with respect to its nuclease activity (e.g., a Cas9 nickase). Thus, in some embodiments, the guide nucleotide sequence-programmable DNA binding protein is a Cas9 nickase. In some embodiments, the guide nucleotide sequence-programmable DNA binding protein is a nuclease inactive Cpf1. In some embodiments, the guide nucleotide sequence-programmable DNA binding protein is a nuclease inactive Argonaute.

In some embodiments, the guide nucleotide sequence-programmable DNA binding protein is a dCas9 domain. In some embodiments, the guide nucleotide sequence-programmable DNA binding protein is a Cas9 nickase. In some embodiments, the dCas9 domain comprises the amino acid sequence of SEQ ID NO: 2 or SEQ ID NO: 3. In some embodiments, the dCas9 domain comprises an amino acid sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.5% identical to any one of the Cas9 domains provided herein (e.g., SEQ ID NOs: 11-260), and comprises mutations corresponding to D10X (X is any amino acid except for D) and/or H840X (X is any amino acid except for H) in SEQ ID NO: 1. In some embodiments, the dCas9 domain comprises an amino acid sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.5% identical to any one of the Cas9 domains provided herein (e.g., SEQ ID NOs: 11-260), and comprises mutations corresponding to D10A and/or H840A in SEQ ID NO: 1. In some embodiments, the Cas9 nickase comprises an amino acid sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.5% identical to any one of the Cas9 domains provided herein (e.g., SEQ ID NOs: 11-260), and comprises mutations corresponding to D10X (X is any amino acid except for D) in SEQ ID NO: 1 and a histidine at the position corresponding to position 840 in SEQ ID NO: 1. In some embodiments, the Cas9 nickase comprises an amino acid sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.5% identical to any one of the Cas9 domains provided herein (e.g., SEQ ID NOs: 11-260), and comprises mutations corresponding to D10A in SEQ ID NO: 1 and a histidine at the position corresponding to position 840 in SEQ ID NO: 1. In some embodiments, variants or homologues of dCas9 or Cas9 nickase (e.g., variants of SEQ ID NO: 2 or SEQ ID NO: 3, respectively) are provided which are at least about 70% identical, at least about 80% identical, at least about 90% identical, at least about 95% identical, at least about 98% identical, at least about 99% identical, at least about 99.5% identical, or at least about 99.9% to SEQ ID NO: 2 or SEQ ID NO: 3, respectively, and comprises mutations corresponding to D10A and/or H840A in SEQ ID NO: 1. In some embodiments, variants of Cas9 (e.g., variants of SEQ ID NO: 2) are provided having amino acid sequences which are shorter, or longer than SEQ ID NO: 2, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids, or more, provided that the dCas9 variants comprise mutations corresponding to D10A and/or H840A in SEQ ID NO: 1. In some embodiments, variants of Cas9 nickase (e.g., variants of SEQ ID NO: 3) are provided having amino acid sequences which are shorter, or longer, than SEQ ID NO: 3, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids, or more, provided that the dCas9 variants comprise mutations corresponding to D10A and comprises a histidine at the position corresponding to position 840 in SEQ ID NO: 1.

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., *Nature Biotechnology.* 2013; 31(9): 833-838, which are incorporated herein by reference), or K603R (See, e.g., Chavez et al., *Nature Methods* 12, 326-328, 2015, which is incorporated herein by reference).

In some embodiments, the nucleobase editors described herein comprise a Cas9 domain with decreased electrostatic interactions between the Cas9 domain and the sugar-phosphate backbone of a target DNA, as compared to a wild-type Cas9 domain. In some embodiments, a Cas9 domain comprises one or more mutations that decreases the association between the Cas9 domain and a sugar-phosphate backbone of a DNA. In some embodiments, the nucleobase editors useful in the present disclosure comprises a dCas9 (e.g., with D10A and H840A mutations) or a Cas9 nickase (e.g., with D10A mutation), wherein the dCas9 or the Cas9 nickase further comprises one or more of a N497X, a R661X, a Q695X, and/or a Q926X mutation of the amino acid sequence provided in SEQ ID NO: 1, or a corresponding mutation in any of the amino acid sequences provided in SEQ ID NOs: 11-260, wherein X is any amino acid. In some embodiments, the nucleobase editors described herein comprises a dCas9 (e.g., with D10A and H840A mutations) or a Cas9 nickase (e.g., with D10A mutation), wherein the dCas9 or the Cas9 nickase further comprises one or more of a N497A, a R661A, a Q695A, and/or a Q926A mutation of the amino acid sequence provided in SEQ ID NO: 1, or a corresponding mutation in any of the amino acid sequences provided in SEQ ID NOs: 11-260. In some embodiments, the dCas9 domain (e.g., of any of the nucleobase editors provided herein) comprises the amino acid sequence as set forth in any one of SEQ ID NOs: 2-9. In some embodiments, the nucleobase editor comprises the amino acid sequence as set forth in any one of SEQ ID NOs: 10 or 293-302.

```
Cas9 variant with decreased electrostatic interactions between the Cas9 and DNA back-
bone
DKKYSIGLAIGTNSVGWAVITDEYKVPSKKFKVLGNTDRHSIKKNLIGALLFDSGETALATRLKRTARR

RYTRRKNRICYLQEIFSNEMAKVDDSFFHRLEESFLVEEDKKHERHPIFGNIVDEVAYHEKYPTIYHLRK

KLVDSTDKADLRLIYLALAHMIKFRGHFLIEGDLNPDNSDVDKLFIQLVQTYNQLFEENPINASGVDAK

AILSARLSKSRRLENLIAQLPGEKKNGLFGNLIALSLGLTPNFKSNFDLAEDAKLQLSKDTYDDDLDNLL

AQIGDQYADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVVDKGASA

QSFIERMTAFDKNLPNEKVLPKHSLLYEYFTVYNELTKVKYVTEGMRKPAFLSGEQKKAIVDLLFKTN

RKVTVKQLKEDYFKKIECFDSVEISGVEDRFNASLGTYHDLLKIIKDKDFLDNEENEDILEDIVLTLTLFE

DREMIEERLKTYAHLFDDKVMKQLKRRRYTGWGALSRKLINGIRDKQSGKTILDFLKSDGFANRNFM

ALIHDDSLTFKEDIQKAQVSGQGDSLHEHIANLAGSPAIKKGILQTVKVVDELVKVMGRHKPENIVIEM

ARENQTTQKGQKNSRERMKRIEEGIKELGSQILKEHPVENTQLQNEKLYLYYLQNGRDMYVDQELDIN

RLSDYDVDHIVPQSFLKDDSIDNKVLTRSDKNRGKSDNVPSEEVVKKMKNYWRQLLNAKLITQRKFD

NLTKAERGGLSELDKAGFIKRQLVETRAITKHVAQILDSRMNTKYDENDKLIREVKVITLKSKLVSDFR

KDFQFYKVREINNYHHAHDAYLNAVVGTALIKKYPKLESEFVYGDYKVYDVRKMIAKSEQEIGKATA

KYFFYSNIMNFFKTEITLANGEIRKRPLIETNGETGEIVWDKGRDFATVRKVLSMPQVNIVKKTEVQTG

GFSKESILPKRNSDKLIARKKDWDPKKYGGFDSPTVAYSVLVVAKVEKGKSKKLKSVKELLGITIMERS

SFEKNPIDFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGD (SEQ ID NO: 9, mutations relative to SEQ ID NO: 1 are bolded and underlined)

High fidelity nucleobase editor
msSETGPVAVDPTLRRRIEPHEFEVFFDPRELRKETCLLYEINWGGRHSIWRHTSQNTNKHVEVNFIEKF

TTERYFCPNTRCSITWFLSWSPCGECSRAITEFLSRYPHVTLFIYIARLYHHADPRNRQGLRDLISSGVTI

QIMTEQESGYCWRNFVNYSPSNEAHWPRYPHLWVRLYVLELYCIILGLPPCLNILRRKQPQLTFFTIALQ

SCHYQRLPPHILWATGLKSGSETPGTSESATPESDKKYSIGLAIGTNSVGWAVITDEYKVPSKKFKVLG
```

```
NTDRHSIKKNLIGALLFDSGETALATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYLALAHMIKFRGHFLIEGDLN

PDNSDVDKLFIQLVQTYNQLFEENPINASGVDAKAILSARLSKSRRLENLIAQLPGEKKNGLFGNLIALS

LGLTPNFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKPILEKM

DGTEELLVKLNREDLLRKQRTFDNGSIPHQIHLGELHAILRRQEDFYPFLKDNREKIEKILTFRIPYYVGP

LARGNSRFAWMTRKSEETITPWNFEEVVDKGASAQSFIERMTAFDKNLPNEKVLPKHSLLYEYFTVYN

ELTKVKYVTEGMRKPAFLSGEQKKAIVDLLFKTNRKVTVKQLKEDYFKKIECFDSVEISGVEDRFNASL

GTYHDLLKIIKDKDFLDNEENEDILEDIVLTLTLFEDREMIEERLKTYAHLFDDKVMKQLKRRRYTGWG

ALSRKLINGIRDKQSGKTILDFLKSDGFANRNFMALIHDDSLTFKEDIQKAQVSGQGDSLHEHIANLAGS

PAIKKGILQTVKVVDELVKVMGRHKPENIVIEMARENQTTQKGQKNSRERMKRIEEGIKELGSQILKEH

PVENTQLQNEKLYLYYLQNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIKRQLVETRAITKHVAQIL

DSRMNTKYDENDKLIREVKVITLKSKLVSDFRKDFQFYKVREINNYHHAHDAYLNAVVGTALIKKYPK

LESEFVYGDYKVYDVRKMIAKSEQEIGKATAKYFFYSNIMNFFKTEITLANGEIRKRPLIETNGETGEIV

WDKGRDFATVRKVLSMPQVNIVKKTEVQTGGFSKESILPKRNSDKLIARKKDWDPKKYGGFDSPTVA

YSVLVVAKVEKGKSKKLKSVKELLGITIMERSSFEKNPIDFLEAKGYKEVKKDLIIKLPKYSLFELENGR

KRMLASAGELQKGNELALPSKYVNFLYLASHYEKLKGSPEDNEQKQLFVEQHKHYLDEIIEQISEFSKR

VILADANLDKVLSAYNKHRDKPIREQAENIIHLFTLTNLGAPAAFKYFDTTIDRKRYTSTKEVLDATLIH

QSITGLYETRIDLSQLGGD  (SEQ ID NO: 321)
```

In some embodiments, the guide nucleotide sequence-programmable DNA binding protein is a single effector of a microbial CRISPR-Cas system. Single effectors of microbial CRISPR-Cas systems include, without limitation, Cas9, Cpf1, C2c1, C2c2, and C2c3. Typically, microbial CRISPR-Cas systems are divided into Class 1 and Class 2 systems. Class 1 systems have multisubunit effector complexes, while Class 2 systems have a single protein effector. Cas9 and Cpf1 are Class 2 effectors. In addition to Cas9 and Cpf1, three distinct Class 2 CRISPR-Cas systems (C2c1, C2c2, and C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which are herein incorporated by reference. Effectors of two of the systems, C2c1 and C2c3, contain RuvC-like endonuclease domains related to Cpf1. A third system, C2c2 contains an effector with two predicted HEPN RNase domains. Production of mature CRISPR RNA is tracrRNA-independent, unlike production of CRISPR RNA by C2c1. C2c1 depends on both CRISPR RNA and tracrRNA for DNA cleavage. Bacterial C2c2 has been shown to possess a unique RNase activity for CRISPR RNA maturation distinct from its RNA-activated single-stranded RNA degradation activity. These RNase functions are different from each other and from the CRISPR RNA-processing behavior of Cpf1. See, e.g., East-Seletsky, et al., "Two distinct RNase activities of CRISPR-C2c2 enable guide-RNA processing and RNA detection", *Nature,* 2016 Oct. 13; 538(7624):270-273, the entire contents of which are hereby incorporated by reference. In vitro biochemical analysis of C2c2 in *Leptotrichia shahii* has shown that C2c2 is guided by a single CRISPR RNA and can be programmed to cleave ssRNA targets carrying complementary protospacers. Catalytic residues in the two conserved HEPN domains mediate cleavage. Mutations in the catalytic residues generate catalytically inactive RNA-binding proteins. See e.g., Abudayyeh et al., "C2c2 is a single-component programmable RNA-guided RNA-targeting CRISPR effector," *Science,* 2016 Aug. 5; 353(6299), the entire contents of which are hereby incorporated by reference.

The crystal structure of Alicyclobaccillus acidoterrastris C2c1 (AacC2c1) has been reported in complex with a chimeric single-molecule guide RNA (sgRNA). See, e.g., Liu et al., "C2c1-sgRNA Complex Structure Reveals RNA-Guided DNA Cleavage Mechanism", *Mol. Cell,* 2017 Jan. 19; 65(2):310-322, incorporated herein by reference. The crystal structure has also been reported for Alicyclobacillus acidoterrestris C2c1 bound to target DNAs as ternary complexes. See, e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the nucleobase editors described herein comprise a C2c1, a C2c2, or a C2c3 protein. In some embodiments, the guide nucleotide sequence-programmable DNA binding protein is a C2c 1 protein. In some embodiments, the guide nucleotide sequence-programmable DNA binding protein is a C2c2 protein. In some embodiments, the guide nucleotide sequence-programmable DNA binding protein is a C2c3 protein. In some embodiments, the guide nucleotide sequence-programmable DNA binding protein comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring C2c1, C2c2, or C2c3 protein. In some embodiments, the guide nucleotide sequence-programmable DNA binding protein is a naturally-occurring C2c1, C2c2, or C2c3 protein. In some embodiments, the guide nucleotide sequence-programmable DNA binding protein comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NOs: 756-758. In some embodiments, the guide nucleotide sequence-programmable DNA binding protein comprises an amino acid sequence of any one SEQ ID NOs: 756-758. It should be appreciated that C2c1, C2c2, or C2c3 from other bacterial species may also be used in accordance with the present disclosure.

```
C2c1 (uniprot.org/uniprot/T0D7A2#)
sp|T0D7A2|C2C1_ALIAG CRISPR-associated endonuclease C2c1 OS = Alicyclobacillus
acidoterrestris
(strain ATCC 49025 / DSM 3922 / CIP 106132 / NCIMB 13137 / GD3B)
GN = c2c1 PE = 1 SV = 1
                                                              (SEQ ID NO: 2470)
MAVKSIKVKLRLDDMPEIRAGLWKLHKEVNAGVRYYTEWLSLLRQENLYRRSPNGDGEQECDKTAE

ECKAELLERLRARQVENGHRGPAGSDDELLQLARQLYELLVPQAIGAKGDAQQIARKFLSPLADKDAV

GGLGIAKAGNKPRWVRMREAGEPGWEEEKEKAETRKSADRTADVLRALADFGLKPLMRVYTDSEMS

SVEWKPLRKGQAVRTWDRDMFQQAIERMMSWESWNQRVGQEYAKLVEQKNRFEQKNFVGQEHLV

HLVNQLQQDMKEASPGLESKEQTAHYVTGRALRGSDKVFEKWGKLAPDAPFDLYDALIKNVQRRNT

RRFGSHDLFAKLAEPEYQALWREDASFLTRYAVYNSILRKLNHAKMFATFTLPDATAHPIWTRFDKLG

GNLHQYTFLFNEFGERRHAIRFHKLLKVENGVAREVDDVTVPISMSEQLDNLLPRDPNEPIALYFRDYG

AEQHFTGEFGGAKIQCRRDQLAHMHRRRGARDVYLNVSVRVQSQSEARGERRPPYAAVFRLVGDNH

RAFVHFDKLSDYLAEHPDDGKLGSEGLLSGLRVMSVDLGLRTSASISVFRVARKDELKPNSKGRVPFFF

PIKGNDNLVAVHERSQLLKLPGETESKDLRAIREERQRTLRQLRTQLAYLRLLVRCGSEDVGRRERSW

AKLIEQPVDAANHMTPDWREAFENELQKLKSLHGICSDKEWMDAVYESVRRVWRHMGKQVRDWRK

DVRSGERPKIRGYAKDVVGGNSIEQIEYLERQYKFLKSWSFFGKVSGQVIRAEKGSRFAITLREHIDHAK

EDRLKKLADRIIMEALGYVYALDERGKGKWVAKYPPCQLILLEELSEYQFNNDRPPSENNQLMQWSH

RGVFQELINQAQVHDLLVGTMYAAFSSRFDARTGAPGIRCRRVPARCTQEHNPEPFPWWLNKFVVEHT

LDACPLRADDLIPTGEGEIFVSPFSAEEGDFHQIHADLNAAQNLQQRLWSDFDISQIRERCDWGEVDGE

LVLIPRLTGKRTADSYSNKVFYTNTGVTYYERERGKKRRKVFAQEKLSEEEAELLVEADEAREKSVVL

MRDPSGIINRGNWTRQKEFWSMVNQRIEGYLVKQIRSRVPLQDSACENTGDI

C2c2 (uniprot.org/uniprot/P0DOC6)
>sp|P0DOC6|C2C2_LEPSD CRISPR-associated endoribonuclease C2c2 OS = Leptotri-
chia
shahii
(strain DSM 19757 / CCUG 47503 / CIP 107916 / JCM 16776 / LB37) GN = c2c2
PE = 1 SV = 1
                                                              (SEQ ID NO: 2471)
MGNLFGHKRWYEVRDKKDFKIKRKVKVKRNYDGNKYILNINENNNKEKIDNNKFIRKYINYKKNDNI

LKEFTRKFHAGNILFKLKGKEGIIRIENNDDFLETEEVVLYIEAYGKSEKLKALGITKKKIIDEAIRQGITK

DDKKIEIKRQENEEEIEIDIRDEYTNKTLNDCSIILRIIENDELETKKSIYEIFKNINMSLYKIIEKIIENETEK

VFENRYYEEHLREKLLKDDKIDVILTNFMEIREKIKSNLEILGFVKFYLNVGGDKKKSKNKKMLVEKIL

NINVDLTVEDIADFVIKELEFWNITKRIEKVKKVNNEFLEKRRNRTYIKSYVLLDKHEKFKIERENKKDK

IVKFFVENIKNNSIKEKIEKILAEFKIDELIKKLEKELKKGNCDTEIFGIFKKHYKVNFDSKKFSKKSDEEK

ELYKIIYRYLKGRIEKILVNEQKVRLKKMEKIEIEKILNESILSEKILKRVKQYTLEHIMYLGKLRHNDID

MTTVNTDDFSRLHAKEELDLELITFFASTNMELNKIFSRENINNDENIDFFGGDREKNYVLDKKILNSKI

KIIRDLDFIDNKNNITNNFIRKFTKIGTNERNRILHAISKERDLQGTQDDYNKVINIIQNLKISDEEVSKAL

NLDVVFKDKKNIITKINDIKISEENNNDIKYLPSFSKVLPEILNLYRNNPKNEPFDTIETEKIVLNALIYVN
```

-continued

```
KELYKKLILEDDLEENESKNIFLQELKKTLGNIDEIDENIIENYYKNAQISASKGNNKAIKKYQKKVIECY

IGYLRKNYEELFDFSDFKMNIQEIKKQIKDINDNKTYERITVKTSDKTIVINDDFEYIISIFALLNSNAVIN

KIRNRFFATSVWLNTSEYQNIIDILDEIMQLNTLRNECITENWNLNLEEFIQKMKEIEKDFDDFKIQTKKE

IFNNYYEDIKNNILTEFKDDINGCDVLEKKLEKIVIFDDETKFEIDKKSNILQDEQRKLSNINKKDLKKKV

DQYIKDKDQEIKSKILCRIIFNSDFLKKYKKEIDNLIEDMESENENKFQEIYYPKERKNELYIYKKNLFLNI

GNPNFDKIYGLISNDIKMADAKFLFNIDGKNIRKNKISEIDAILKNLNDKLNGYSKEYKEKYIKKLKEND

DFFAKNIQNKNYKSFEKDYNRVSEYKKIRDLVEFNYLNKIESYLIDINWKLAIQMARFERDMHYIVNGL

RELGIIKLSGYNTGISRAYPKRNGSDGFYTTTAYYKFFDEESYKKFEKICYGFGIDLSENSEINKPENESIR

NYISHFYIVRNPFADYSIAEQIDRVSNLLSYSTRYNNSTYASVFEVFKKDVNLDYDELKKKFKLIGNNDI

LERLMKPKKVSVLELESYNSDYIKNLIIELLTKIENTNDTL
```

C2c3, translated from >CEPX01008730.1 marine metagenome genome assembly
TARA_037_MES_0.1-0.22, contig TARA_037_MES_0.1-0.22_scaffold22115_1, whole
genome shotgun sequence.
(SEQ ID NO: 2472)

```
MRSNYHGGRNARQWRKQISGLARRTKETVFTYKFPLETDAAEIDFDKAVQTYGIAEGVGHGSLIGLVC

AFHLSGFRLFSKAGEAMAFRNRSRYPTDAFAEKLSAIMGIQLPTLSPEGLDLIFQSPPRSRDGIAPVWSE

NEVRNRLYTNWTGRGPANKPDEHLLEIAGEIAKQVFPKFGGWDDLASDPDKALAAADKYFQSQGDFP

SIASLPAAIMLSPANSTVDFEGDYIAIDPAAETLLHQAVSRCAARLGRERPDLDQNKGPFVSSLQDALVS

SQNNGLSWLFGVGFQHWKEKSPKELIDEYKVPADQHGAVTQVKSFVDAIPLNPLFDTTHYGEFRASVA

GKVRSWVANYWKRLLDLKSLLATTEFTLPESISDPKAVSLFSGLLVDPQGLKKVADSLPARLVSAEEAI

DRLMGVGIPTAADIAQVERVADEIGAFIGQVQQFNNQVKQKLENLQDADDEEFLKGLKIELPSGDKEPP

AINRISGGAPDAAAEISELEEKLQRLLDARSEHFQTISEWAEENAVTLDPIAAMVELERLRLAERGATGD

PEEYALRLLLQRIGRLANRVSPVSAGSIRELLKPVFMEEREFNLFFHNRLGSLYRSPYSTSRHQPFSIDVG

KAKAIDWIAGLDQISSDIEKALSGAGEALGDQLRDWINLAGFAISQRLRGLPDTVPNALAQVRCPDDVR

IPPLLAMLLEEDDIARDVCLKAFNLYVSAINGCLFGALREGFIVRTRFQRIGTDQIHYVPKDKAWEYPDR

LNTAKGPINAAVSSDWIEKDGAVIKPVETVRNLSSTGFAGAGVSEYLVQAPHDWYTPLDLRDVAHLVT

GLPVEKNITKLKRLTNRTAFRMVGASSFKTHLDSVLLSDKIKLGDFTIIIDQHYRQSVTYGGKVKISYEP

ERLQVEAAVPVVDTRDRTVPEPDTLFDHIVAIDLGERSVGFAVFDIKSCLRTGEVKPIHDNNGNPVVGT

VAVPSIRRLMKAVRSHRRRRQPNQKVNQTYSTALQNYRENVIGDVCNRIDTLMERYNAFPVLEFQIKN

FQAGAKQLEIVYGS
```

The Cas9 protein recognizes a short motif (PAM motif) in the CRISPR repeat sequences in the target DNA sequence. A "PAM motif," or "protospacer adjacent motif," as used herein, refers to a DNA sequence immediately following the DNA sequence targeted by the Cas9 nuclease in the CRISPR bacterial adaptive immune system. PAM is a component of the invading virus or plasmid but is not a component of the bacterial CRISPR locus. Wild-type *Streptococcus pyogenes* Cas9 recognizes a canonical PAM sequence (5'-NGG-3'). Other Cas9 nucleases (e.g., Cas9 from *Streptococcus* thermophiles, *Staphylococcus aureus, Neisseria meningitidis*, or *Treponema* denticolaor) and Cas9 variants thereof have been described in the art to have different, or more relaxed PAM requirements. For example, in Kleinstiver et al., *Nature* 523, 481-485, 2015; Klenstiver et al., *Nature* 529, 490-495, 2016; Ran et al., *Nature*, Apr. 9; 520(7546): 186-191, 2015; Kleinstiver et al., *Nat Biotechnol*, 33(12):1293-1298, 2015; Hou et al., *Proc Natl Acad Sci USA*, 110(39):15644-9, 2014; Prykhozhij et al., *PLoS One*, 10(3): e0119372, 2015; Zetsche et al., *Cell* 163, 759-771, 2015; Gao et al., *Nature Biotechnology*, doi:10.1038/nbt.3547, 2016; Want et al., *Nature* 461, 754-761, 2009; Chavez et al., doi: dx.doi.org/10.1101/058974; Fagerlund et al., *Genome Biol*. 2015; 16: 25, 2015; Zetsche et al., *Cell*, 163, 759-771, 2015; and Swarts et al., *Nat Struct Mol Biol*, 21(9):743-53, 2014, each of which is incorporated herein by reference.

Thus, the guide nucleotide sequence-programmable DNA-binding proteins useful in the present disclosure may recognize a variety of PAM sequences including, without limitation: NGG, NGAN, NGNG, NGAG, NGCG, NNGRRT, NGRRN, NNNRRT, NNNGATT, NNAGAAW, NAAAC, TTN, TTTN, and YTN, wherein Y is a pyrimidine, and N is any nucleobase. In some embodiments, the PAM is located 3' of the target base. In some embodiments, the PAM is located 5' of the target base.

One example of an RNA-programmable DNA-binding protein that has different PAM specificity is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from *Acidaminococcus* and Lachnospiraceae are shown to have efficient genome-editing activity in human cells.

Also useful in the present disclosure are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., *Cell*, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 (SEQ ID NO: 10) inactivates Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A in SEQ ID NO: 10. It is to be understood that any mutations, e.g., substitution mutations, deletions, or insertions that inactivate the RuvC domain of Cpf1 may be used in accordance with the present disclosure.

Thus, in some embodiments, the guide nucleotide sequence-programmable DNA binding protein is a nuclease inactive Cpf1 (dCpf1). In some embodiments, the dCpf1 comprises the amino acid sequence of any one SEQ ID NOs: 261-267. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to SEQ ID NO: 10, and comprises mutations corresponding to D917A, E1006A, D1255A, D917A/E1006A, D917A/D1255A, E1006A/D1255A, or D917A/E1006A/D1255A in SEQ ID NO: 10. Cpf1 from other bacterial species may also be used in accordance with the present disclosure.

```
Wild type Francisella novicida Cpf1 (D917, E1006, and D1255 are
bolded and underlined)
                                                       (SEQ ID NO: 10)
MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIDRGERHLAYYTLVDGKGNIIKQDTFNIIGNDRMKTNYHDKLAAIEKDRDSARKDWKKINNIKE

MKEGYLSQVVHEIAKLVIEYNAIVVFEDLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

Francisella novicida Cpf1 D917A (A917, E1006, and D1255 are
bolded and underlined)
                                                       (SEQ ID NO: 261)
MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT
```

-continued

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIARGERHLAYYTLVDGKGNIIKQDTFNIIGNDRMKTNYHDKLAAIEKDRDSARKDWKKINNIKE

MKEGYLSQVVHEIAKLVIEYNAIVVFEDLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

*Francisella novicida* Cpf1 E1006A (D917, A1006, and D1255 are bolded and underlined)

(SEQ ID NO: 262)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIDRGERHLAYYTLVDGKGNIIKQDTFNIIGNDRMKTNYHDKLAAIEKDRDSARKDWKKINNIKE

MKEGYLSQVVHEIAKLVIEYNAIVVFADLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

*Francisella novicida* Cpf1 D1255A (D917, E1006, and A1255 are bolded and underlined)

(SEQ ID NO: 263)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

-continued

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIDRGERHLAYYTLVDGKGNIIKQDTFNIIGNDRMKTNYHDKLAAIEKDRDSARKDWKKINNIKE

MKEGYLSQVVHEIAKLVIEYNAIVVFEDLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN

*Francisella novicida* Cpf1 D917A/E1006A (A917, A1006, and D1255 are bolded and underlined)

(SEQ ID NO: 264)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIARGERHLAYYTLVDGKGNIIKQDTFNIIGNDRMKTNYHDKLAAIEKDRDSARKDWKKINNIKE

MKEGYLSQVVHEIAKLVIEYNAIVVFADLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

*Francisella novicida* Cpf1 D917A/D1255A (A917, E1006, and A1255 are bolded and underlined)

(SEQ ID NO: 265)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

-continued

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLEKAND

VHILSIARGERHLAYYTLVDGKGNIIKQDTFNIIGNDRMKTNYHDKLAAIEKDRDSARKDWKKINNIKE

MKEGYLSQVVHEIAKLVIEYNAIVVEDLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN

*Francisella novicida* Cpf1 E1006A/D1255A (D917, A1006, and
A1255 are bolded and underlined)
(SEQ ID NO: 266)
MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLEKAND

VHILSIDRGERHLAYYTLVDGKGNIIKQDTFNIIGNDRMKTNYHDKLAAIEKDRDSARKDWKKINNIKE

MKEGYLSQVVHEIAKLVIEYNAIVVADLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN

*Francisella novicida* Cpf1 D917A/E1006A/D1255A (A917,
A1006, and A1255 are bolded and underlined)
(SEQ ID NO: 267)
MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

-continued

```
LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIARGERHLAYYTLVDGKGNIIKQDTFNIIGNDRMKTNYHDKLAAIEKDRDSARKDWKKINNIKE

MKEGYLSQVVHEIAKLVIEYNAIVVFADLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN
```

In some embodiments, the guide nucleotide sequence-programmable DNA binding protein is a Cpf1 protein from a *Acidaminococcus* species (AsCpf1). Cpf1 proteins form *Acidaminococcus* species have been described previously and would be apparent to the skilled artisan. Exemplary *Acidaminococcus* Cpf1 proteins (AsCpf1) include, without limitation, any of the AsCpf1 proteins provided herein.

Wild-type AsCpf1—Residue R912 is indicated in bold underlining and residues 661-667 are indicated in italics and underlining.

```
                                         (SEQ ID NO: 2473)
TQFEGFTNLYQVSKTLRFELIPQGKTLKHIQEQGFIEEDKARNDHYKELK

PIIDRIYKTYADQCLQLVQLDWENLSAAIDSYRKEKTEETRNALIELQAT

YRNAIHDYFIGRTDNLTDAINKRHAEIYKGLFKAELFNGKVLKQLGTVTT

TEHENALLRSFDKFTTYFSGFYENRKNVFSAEDISTAIPHRIVQDNFPKF

KENCHIFTRLITAVPSLREHFENVKKAIGIFVSTSIEEVFSFPFYNQLLT

QTQIDLYNQLLGGISREAGTEKIKGLNEVLNLAIQKNDETAHIIASLPHR

FIPLFKQILSDRNTLSFILEEFKSDEEVIQSFCKYKTLLRNENVLETAEA

LFNELNSIDLTHIFISHKKLETISSALCDHWDTLRNALYERRISELTGKI

TKSAKEKVQRSLKHEDINLQEIISAAGKELSEAFKQKTSEILSHAHAALD

QPLPTTMLKKQEEKEILKSQLDSLLGLYHLLDWFAVDESNEVDPEFSARL

TGIKLEMEPSLSFYNKARNYATKKPYSVEKFKLNFQMPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYAKKTGDQKGYREALCKWIDFTRDFLSKYTKTTSIDLSSLRP

SSQYKDLGEYYAELNPLLYHISFQRIAEKEIMDAVETGKLYLFQIYNKDF

AKGHHGKPNLHTLYWTGLFSPENLAKTSIKLNGQAELFYRPKSRMKRMAH

RLGEKMLNKKLKDQKTPIPDTLYQELYDYVNHRLSHDLSDEARALLPNVI

TKEVSHEIIKDRRFTSDKFFFHVPITLNYQAANSPSKFNQRVNAYLKEHP

ETPIIGIDRGERNLIYITVIDSTGKILEQRSLNTIQQFDYQKKLDNREKE

RVAAARQAWSVVGTIKDLKQGYLSQVIHEIVDLMIHYQAVVVLENLNFGFK

SKRTGIALKAVYQQFEKMLIDKLNCLVLKDYPAEKVGGVLNPYQLTDQFT

SFAKMGTQSGFLFYVPAPYTSKIDPLTGFVDPFVWKTIKNHESRKHFLEG

FDFLHYDVKTGDFILHFKMNRNLSFQRGLPGFMPAWDIVFEKNETQFDAK

GTPFIAGKRIVPVIENHRFTGRYRDLYPANELIALLEEKGIVFRDGSNIL

PKLLENDDSHAIDTMVALIRSVLQMRNSNAATGEDYINSPVRDLNGVCFD

SRFQNPEWPMDADANGAYHIALKGQLLLNHLKESKDLKLQNGISNQDWLA

YIQELRN
```

AsCpf1(R912A)—Residue A912 is indicated in bold underlining and residues 661-667 are indicated in italics and underlining.

```
                                         (SEQ ID NO: 2474)
TQFEGFTNLYQVSKTLRFELIPQGKTLKHIQEQGFIEEDKARNDHYKELK

PIIDRIYKTYADQCLQLVQLDWENLSAAIDSYRKEKTEETRNALIELQAT

YRNAIHDYFIGRTDNLTDAINKRHAEIYKGLFKAELFNGKVLKQLGTVTT

TEHENALLRSFDKFTTYFSGFYENRKNVFSAEDISTAIPHRIVQDNFPKF

KENCHIFTRLITAVPSLREHFENVKKAIGIFVSTSIEEVFSFPFYNQLLT

QTQIDLYNQLLGGISREAGTEKIKGLNEVLNLAIQKNDETAHIIASLPHR

FIPLFKQILSDRNTLSFILEEFKSDEEVIQSFCKYKTLLRNENVLETAEA
```

```
LFNELNSIDLTHIFISHKKLETISSALCDHWDTLRNALYERRISELTGKI

TKSAKEKVQRSLKHEDINLQEIISAAGKELSEAFKQKTSEILSHAHAALD

QPLPTTMLKKQEEKEILKSQLDSLLGLYHLLDWFAVDESNEVDPEFSARL

TGIKLEMEPSLSFYNKARNYATKKPYSVEKFKLNFQMPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYAKKTGDQKGYREALCKWIDFTRDFLSKYTKTTSIDLSSLRP

SSQYKDLGEYYAELNPLLYHISFQRIAEKEIMDAVETGKLYLFQIYNKDF

AKGHHGKPNLHTLYWTGLFSPENLAKTSIKLNGQAELFYRPKSRMKRMAH

RLGEKMLNKKLKDQKTPIPDTLYQELYDYVNHRLSHDLSDEARALLPNVI

TKEVSHEIIKDRRFTSDKFFFHVPITLNYQAANSPSKFNQRVNAYLKEHP

ETPIIGIDRGEANLIYITVIDSTGKILEQRSLNTIQQFDYQKKLDNREKE

RVAARQAWSVVGTIKDLKQGYLSQVIHEIVDLMIHYQAVVVLENLNFGFK

SKRTGIALKAVYQQFEKMLIDKLNCLVLKDYPAEKVGGVLNPYQLTDQFT

SFAKMGTQSGFLFYVPAPYTSKIDPLTGFVDPFVWKTIKNHESRKHFLEG

FDFLHYDVKTGDFILHFKMNRNLSFQRGLPGFMPAWDIVFEKNETQFDAK

GTPFIAGKRIVPVIENHRFTGRYRDLYPANELIALLEEKGIVFRDGSNIL

PKLLENDDSHAIDTMVALIRSVLQMRNSNAATGEDYINSPVRDLNGVCFD

SRFQNPEWPMDADANGAYHIALKGQLLLNHLKESKDLKLQNGISNQDWLA

YIQELRN
```

In some embodiments, the nucleic acid programmable DNA binding protein is a Cpf1 protein from a Lachnospiraceae species (LbCpf1). Cpf1 proteins form Lachnospiraceae species have been described previously have been described previously and would be apparent to the skilled artisan. Exemplary Lachnospiraceae Cpf1 proteins (LbCpf1) include, without limitation, any of the LbCpf1 proteins provided herein.

```
Wild-type LbCpf1
                                              (SEQ ID NO: 2475)
MSKLEKFTNCYSLSKTLRFKAIPVGKTQENIDNKRLLVEDEKRAEDYKGVKKLLDRYYLSFINDVEHSI

KLKNLNNYISLFRKKTRTEKENKELENLEINLRKEIAKAFKGNEGYKSLFKKDIIETILPEFLDDKDEIAL

VNSFNGFTTAFTGFFDNRENMFSEEAKSTSIAFRCINENLTRYISNMDIFEKVDAIFDKHEVQEIKEKILN

SDYDVEDFFEGEFFNFVLTQEGIDVYNAIIGGFVTESGEKIKGENEYINLYNQKTKQKLPKFKPLYKQVL

SDRESLSFYGEGYTSDEEVLEVFRNTLNKNSEIFSSIKKLEKLFKNFDEYSSAGIFVKNGPAISTISKDIFG

EWNVIRDKWNAEYDDIHLKKKAVVTEKYEDDRRKSFKKIGSFSLEQLQEYADADESVVEKLKEIIIQK

VDEIYKVYGSSEKLFDADFVLEKSLKKNDAVVAIMKDLLDSVKSFENYIKAFFGEGKETNRDESFYGD

FVLAYDILLKVDHIYDAIRNYVTQKPYSKDKFKLYFQNPQFMGGWDKDKETDYRATILRYGSKYYLAI

MDKKYAKCLQKIDKDDVNGNYEKINYKLLPGPNKMLPKVFFSKKWMAYYNPSEDIQKIYKNGTFKK

GDMFNLNDCHKLIDFFKDSISRYPKWSNAYDFNFSETEKYKDIAGFYREVEEQGYKVSFESASKKEVD

KLVEEGKLYMFQIYNKDFSDKSHGTPNLHTMYFKLLFDENNHGQIRLSGGAELFMRRASLKKEELVVH

PANSPIANKNPDNPKKTTTLSYDVYKDKRFSEDQYELHIPIAINKCPKNIFKINTEVRVLLKHDDNPYVI

GIDRGERNLLYIVVVDGKGNIVEQYSLNEIINNFNGIRIKTDYHSLLDKKEKERFEARQNWTSIENIKELK

AGYISQVVHKICELVEKYDAVIALEDLNSGFKNSRVKVEKQVYQKFEKMLIDKLNYMVDKKSNPCAT

GGALKGYQITNKFESFKSMSTQNGFIFYIPAWLTSKIDPSTGFVNLLKTKYTSIADSKKFISSFDRIMYVP

EEDLFEFALDYKNFSRTDADYIKKWKLYSYGNRIRIFRNPKKKNNVFDWEEVCLTSAYKELFNKYGINY

QQGDIRALLCEQSDKAFYSSFMALMSLMLQMRNSITGRTDVDFLISPVKNSDGIFYDSRNYEAQENAIL

PKNADANGAYNIARKVLWAIGQFKKAEDEKLDKVKIAISNKEWLEYAQTSVKH

LbCpf1 (R836A)
                                              (SEQ ID NO: 2476)
MSKLEKFTNCYSLSKTLRFKAIPVGKTQENIDNKRLLVEDEKRAEDYKGVKKLLDRYYLSFINDVLHSI

KLKNLNNYISLFRKKTRTEKENKELENLEINLRKEIAKAFKGNEGYKSLFKKDIIETILPEFLDDKDEIAL

VNSFNGFTTAFTGFFDNRENMFSEEAKSTSIAFRCINENLTRYISNMDIFEKVDAIFDKHEVQEIKEKILN

SDYDVEDFFEGEFFNFVLTQEGIDVYNAIIGGFVTESGEKIKGLNEYINLYNQKTKQKLPKFKPLYKQVL

SDRESLSFYGEGYTSDEEVLEVFRNTLNKNSEIFSSIKKLEKLFKNFDEYSSAGIFVKNGPAISTISKDIFG

EWNVIRDKWNAEYDDIHLKKKAVVTEKYEDDRRKSFKKIGSFSLEQLQEYADADLSVVEKLKEIIIQK

VDEIYKVYGSSEKLFDADFVLEKSLKKNDAVVAIMKDLLDSVKSFENYIKAFFGEGKETNRDESFYGD
```

```
FVLAYDILLKVDHIYDAIRNYVTQKPYSKDKFKLYFQNPQFMGGWDKDKETDYRATILRYGSKYYLAI

MDKKYAKCLQKIDKDDVNGNYEKINYKLLPGPNKMLPKVFFSKKWMAYYNPSEDIQKIYKNGTFKK

GDMFNLNDCHKLIDFFKDSISRYPKWSNAYDFNFSETEKYKDIAGFYREVEEQGYKVSFESASKKEVD

KLVEEGKLYMFQIYNKDFSDKSHGTPNLHTMYFKLLFDENNHGQIRLSGGAELFMRRASLKKEELVVH

PANSPIANKNPDNPKKTTTLSYDVYKDKRFSEDQYELHIPIAINKCPKNIFKINTEVRVLLKHDDNPYVI

GIDRGEANLLYIVVVDGKGNIVEQYSLNEIINNFNGIRIKTDYHSLLDKKEKERFEARQNWTSIENIKEL

KAGYISQVVHKICELVEKYDAVIALEDENSGFKNSRVKVEKQVYQKFEKMLIDKLNYMVDKKSNPCA

TGGALKGYQITNKFESFKSMSTQNGFIFYIPAWLTSKIDPSTGFVNLLKTKYTSIADSKKFISSFDRIMYV

PEEDLFEFALDYKNFSRTDADYIKKWKLYSYGNRIRIFRNPKKNNVFDWEEVCLTSAYKELFNKYGIN

YQQGDIRALLCEQSDKAFYSSFMALMSLMLQMRNSITGRTDVDFLISPVKNSDGIFYDSRNYEAQENAI

LPKNADANGAYNIARKVLWAIGQFKKAEDEKLDKVKIAISNKEWLEYAQTSVKH

LbCpf1 (R1138A)                                                (SEQ ID NO: 2477)
MSKLEKFTNCYSLSKTERFKAIPVGKTQENIDNKRLLVEDEKRAEDYKGVKKLLLDRYYLSFINDVLHSI

KLKNLNNYISLFRKKTRTEKENKELENLEINERKEIAKAFKGNEGYKSLFKKDIIETILPEFLDDKDEIAL

VNSFNGFTTAFTGFFDNRENMFSEEAKSTSIAFRCINENLTRYISNMDIFEKVDAIFDKHEVQEIKEKILN

SDYDVEDFFEGEFFNFVLTQEGIDVYNAIIGGFVTESGEKIKGLNEYINLYNQKTKQKLPKFKPLYKQVL

SDRESLSFYGEGYTSDEEVLEVFRNTLNKNSEIFSSIKKLEKLFKNFDEYSSAGIFVKNGPAISTISKDIFG

EWNVIRDKWNAEYDDIHLKKKAVVTEKYEDDRRKSFKKIGSFSLEQLQEYADADLSVVEKLKEIIQK

VDEIYKVYGSSEKLFDADFVLEKSLKKNDAVVAIMKDLLDSVKSFENYIKAFFGEGKETNRDESFYGD

FVLAYDILLKVDHIYDAIRNYVTQKPYSKDKFKLYFQNPQFMGGWDKDKETDYRATILRYGSKYYLAI

MDKKYAKCLQKIDKDDVNGNYEKINYKLLPGPNKMLPKVFFSKKWMAYYNPSEDIQKIYKNGTFKK

GDMFNLNDCHKLIDFFKDSISRYPKWSNAYDFNFSETEKYKDIAGFYREVEEQGYKVSFESASKKEVD

KLVEEGKLYMFQIYNKDFSDKSHGTPNLHTMYFKLLFDENNHGQIRLSGGAELFMRRASLKKEELVVH

PANSPIANKNPDNPKKTTTLSYDVYKDKRFSEDQYELHIPIAINKCPKNIFKINTEVRVLLKHDDNPYVI

GIDRGERNLLYIVVVDGKGNIVEQYSLNEIINNFNGIRIKTDYHSLLDKKEKERFEARQNWTSIENIKELK

AGYISQVVHKICELVEKYDAVIALEDLNSGFKNSRVKVEKQVYQKFEKMLIDKLNYMVDKKSNPCAT

GGALKGYQITNKFESFKSMSTQNGFIFYIPAWLTSKIDPSTGFVNLLKTKYTSIADSKKFISSFDRIMYVP

EEDLFEFALDYKNFSRTDADYIKKWKLYSYGNRIRIFRNPKKNNVFDWEEVCLTSAYKELFNKYGINY

QQGDIRALLCEQSDKAFYSSFMALMSLMLQMANSITGRTDVDFLISPVKNSDGIFYDSRNYEAQENAIL

PKNADANGAYNIARKVLWAIGQFKKAEDEKLDKVKIAISNKEWLEYAQTSVKH
```

In some embodiments, the Cpf1 protein is a crippled Cpf1 protein. As used herein a "crippled Cpf1" protein is a Cpf1 protein having diminished nuclease activity as compared to a wild-type Cpf1 protein. In some embodiments, the crippled Cpf1 protein preferentially cuts the target strand more efficiently than the non-target strand. For example, the Cpf1 protein preferentially cuts the strand of a duplexed nucleic acid molecule in which a nucleotide to be edited resides. In some embodiments, the crippled Cpf1 protein preferentially cuts the non-target strand more efficiently than the target strand. For example, the Cpf1 protein preferentially cuts the strand of a duplexed nucleic acid molecule in which a nucleotide to be edited does not reside. In some embodiments, the crippled Cpf1 protein preferentially cuts the target strand at least 5% more efficiently than it cuts the non-target strand. In some embodiments, the crippled Cpf1 protein preferentially cuts the target strand at least 5%, 10%, 15%, 20%, 25%, 30%, 35%, 40%, 50%, 60%, 70%, 80%, 90%, or at least 100% more efficiently than it cuts the non-target strand.

In some embodiments, a crippled Cpf1 protein is a non-naturally occurring Cpf1 protein. In some embodiments, the crippled Cpf1 protein comprises one or more mutations relative to a wild-type Cpf1 protein. In some embodiments, the crippled Cpf1 protein comprises 1, 2, 3, 4, 5, 6, 7, 8, 9, 10, 11, 12, 13, 14, 15, 16, 17, 18, 19, or 20 mutations relative to a wild-type Cpf1 protein. In some embodiments, the crippled Cpf1 protein comprises an R836A mutation as set forth in SEQ ID NO: 763, or in a corresponding amino acid in another Cpf1 protein. It should be appreciated that a Cpf1 comprising a homologous residue (e.g., a corresponding amino acid) to R836A of SEQ ID NO:

763 could also be mutated to achieve similar results. In some embodiments, the crippled Cpf1 protein comprises a R1138A mutation as set forth in SEQ ID NO: 763, or in a corresponding amino acid in another Cpf1 protein. In some embodiments, the crippled Cpf1 protein comprises an R912A mutation as set forth in SEQ ID NO: 762, or in a corresponding amino acid in another Cpf1 protein. Without wishing to be bound by any particular theory, residue R838 of SEQ ID NO: 763 (LbCpf1) and residue R912 of SEQ ID NO: 762 (AsCpf1) are examples of corresponding (e.g., homologous) residues. For example, a portion of the alignment between SEQ ID NO: 762 and 763 shows that R912 and R838 are corresponding residues.

In some embodiments, any of the Cpf1 proteins provided herein comprises one or more amino acid deletions. In some embodiments, any of the Cpf1 proteins provided herein comprises 1, 2, 3, 4, 5, 6, 7, 8, 9, 10, 11, 12, 13, 14, 15, 16, 17, 18, 19, or 20 amino acid deletions. Without wishing to be bound by any particular theory, there is a helical region in Cpf1, which includes residues 661-667 of AsCpf1 (SEQ ID NO: 762), that may obstruct the function of a deaminase (e.g., APOBEC) that is fused to the Cpf1. This region comprises the amino acid sequence KKTGDQK. Accordingly, aspects of the disclosure provide Cpf1 proteins comprising mutations (e.g., deletions) that disrupt this helical region in Cpf1. In some embodiments, the Cpf1 protein comprises one or more deletions of the following residues in SEQ ID NO: 762, or one or more corresponding deletions in another Cpf1 protein: K661, K662, T663, G664, D665, Q666, and K667. In some embodiments, the Cpf1 protein comprises a T663 and a D665 deletion in SEQ ID NO: 762, or corresponding deletions in another Cpf1 protein. In some embodiments, the Cpf1 protein comprises a K662, T663, D665, and Q666 deletion in SEQ ID NO: 762, or corresponding deletions in another Cpf1 protein. In some embodiments, the Cpf1 protein comprises a K661, K662, T663, D665, Q666 and K667 deletion in SEQ ID NO: 762, or corresponding deletions in another Cpf1 protein.

```
AsCpf1 (deleted T663 and D665)
                                                      (SEQ ID NO: 2478)
TQFEGFTNLYQVSKTLRFELIPQGKTLKHIQEQGFIEEDKARNDHYKELKPIIDRIYKTYADQCLQLVQL

DWENLSAAIDSYRKEKTEETRNALIELQATYRNAIHDYFIGRTDNLTDAINKRHAEIYKGLFKAELFNG

KVLKQLGTVTTTEHENALLRSFDKFTTYFSGFYENRKNVFSAEDISTAIPHRIVQDNFPKFKENCHIFTRL

ITAVPSLREHFENVKKAIGIFVSTSIEEVFSFPFYNQLLTQTQIDLYNQLLGGISREAGTEKIKGLNEVLNL

AIQKNDETAHIIASLPHRFIPLFKQILSDRNTLSFILEEFKSDEEVIQSFCKYKTLLRNENVLETAEALFNEL

NSIDLTHIFISHKKLETISSALCDHWDTLRNALYERRISELTGKITKSAKEKVQRSLKHEDINLQEIISAAG

KELSEAFKQKTSEILSHAHAALDQPLPTTMLKKQEEKEILKSQLDSLLGLYHLLDWFAVDESNEVDPEF

SARLTGIKLEMEPSLSFYNKARNYATKKPYSVEKFKLNFQMPTLASGWDVNKEKNNGAILFVKNGLY

YLGIMPKQKGRYKALSFEPTEKTSEGFDKMYYDYFPDAAKMIPKCSTQLKAVTAHFQTHTTPILLSNNF

IEPLEITKEIYDLNNPEKEPKKFQTAYAKKGQKGYREALCKWIDFTRDFLSKYTKTTSIDLSSLRPSSQY

KDLGEYYAELNPLLYHISFQRIAEKEIMDAVETGKLYLFQIYNKDFAKGHHGKPNLHTLYWTGLFSPEN

LAKTSIKLNGQAELFYRPKSRMKRMAHRLGEKMLNKKLKDQKTPIPDTLYQELYDYVNHRLSHDLSD

EARALLPNVITKEVSHEIIKDRRFTSDKFFFHVPITLNYQAANSPSKFNQRVNAYLKEHPETPIIGIDRGER

NLIYITVIDSTGKILEQRSLNTIQQFDYQKKLDNREKERVAARQAWSVVGTIKDLKQGYLSQVIHEIVDL

MIHYQAVVVLENLNFGFKSKRTGIALKAVYQQFEKMLIDKLNCLVLKDYPAEKVGGVLNPYQLTDQF

TSFAKMGTQSGFLFYVPAPYTSKIDPLTGFVDPFVWKTIKNHESRKHFLEGFDFLHYDVKTGDFILHFK

MNRNLSFQRGLPGFMPAWDIVFEKNETQFDAKGTPFIAGKRIVPVIENHRFTGRYRDLYPANELIALLE

EKGIVFRDGSNILPKLLENDDSHAIDTMVALIRSVLQMRNSNAATGEDYINSPVRDLNGVCFDSRFQNP

EWPMDADANGAYHIALKGQLLLNHLKESKDLKLQNGISNQDWLAYIQELRN

AsCpf1 (deleted K662, T663, D665, and Q666)
                                                      (SEQ ID NO: 2479)
TQFEGFTNLYQVSKTLRFELIPQGKTLKHIQEQGFIEEDKARNDHYKELKPIIDRIYKTYADQCLQLVQL

DWENLSAAIDSYRKEKTEETRNALIELQATYRNAIHDYFIGRTDNLTDAINKRHAEIYKGLFKAELFNG

KVLKQLGTVTTTEHENALLRSFDKFTTYFSGFYENRKNVFSAEDISTAIPHRIVQDNFPKFKENCHIFTRL

ITAVPSLREHFENVKKAIGIFVSTSIEEVFSFPFYNQLLTQTQIDLYNQLLGGISREAGTEKIKGLNEVLNL

AIQKNDETAHIIASLPHRFIPLFKQILSDRNTLSFILEEFKSDEEVIQSFCKYKTLLRNENVLETAEALFNEL

NSIDLTHIFISHKKLETISSALCDHWDTLRNALYERRISELTGKITKSAKEKVQRSLKHEDINLQEIISAAG

KELSEAFKQKTSEILSHAHAALDQPLPTTMLKKQEEKEILKSQLDSLLGLYHLLDWFAVDESNEVDPEF
```

-continued

```
SARLTGIKLEMEPSLSFYNKARNYATKKPYSVEKFKLNFQMPTLASGWDVNKEKNNGAILFVKNGLY

YLGIMPKQKGRYKALSFEPTEKTSEGFDKMYYDYFPDAAKMIPKCSTQLKAVTAHFQTHTTPILLSNNF

IEPLEITKEIYDLNNPEKEPKKFQTAYAKGKGYREALCKWIDFTRDFLSKYTKTTSIDLSSLRPSSQYKDL

GEYYAELNPLLYHISFQRIAEKEIMDAVETGKLYLFQIYNKDFAKGHHGKPNLHTLYWTGLFSPENLAK

TSIKLNGQAELFYRPKSRMKRMAHRLGEKMLNKKLKDQKTPIPDTLYQELYDYVNHRLSHDLSDEAR

ALLPNVITKEVSHEIIKDRRFTSDKFFFHVPITLNYQAANSPSKFNQRVNAYLKEHPETPIIGIDRGERNLI

YITVIDSTGKILEQRSLNTIQQFDYQKKLDNREKERVAARQAWSVVGTIKDLKQGYLSQVIHEIVDLMI

HYQAVVVLENLNFGFKSKRTGIAEKAVYQQFEKMLIDKLNCLVLKDYPAEKVGGVLNPYQLTDQFTS

FAKMGTQSGFLFYVPAPYTSKIDPLTGFVDPFVWKTIKNHESRKHFLEGFDFLHYDVKTGDFILHFKMN

RNLSFQRGLPGFMPAWDIVFEKNETQFDAKGTPFIAGKRIVPVIENHRFTGRYRDLYPANELIALLEEKG

IVFRDGSNILPKLLENDDSHAIDTMVALIRSVLQMRNSNAATGEDYINSPVRDLNGVCFDSRFQNPEWP

MDADANGAYHIALKGQLLLNHLKESKDLKLQNGISNQDWLAYIQELRN

AsCpf1 (deleted K661, K662, T663,D665, Q666, and K667)
                                                          (SEQ ID NO: 2480)
TQFEGFTNLYQVSKTLRFELIPQGKTLKHIQEQGFIEEDKARNDHYKELKPIIDRIYKTYADQCLQLVQL

DWENLSAAIDSYRKEKTEETRNALIEEQATYRNAIHDYFIGRTDNLTDAINKRHAEIYKGLFKAELFNG

KVLKQLGTVTTTEHENALLRSFDKFTTYFSGFYENRKNVFSAEDISTAIPHRIVQDNFPKFKENCHIFTRL

ITAVPSLREHFENVKKAIGIFVSTSIEEVFSFPFYNQLLTQTQIDLYNQLLGGISREAGTEKIKGLNEVLNL

AIQKNDETAHIIASLPHRFIPLFKQILSDRNTLSFILEEFKSDEEVIQSFCKYKTLLRNENVLETAEALFNEL

NSIDLTHIFISHKKLETISSALCDHWDTLRNALYERRISELTGKITKSAKEKVQRSLKHEDINLQEIISAAG

KELSEAFKQKTSEILSHAHAALDQPLPTTMLKKQEEKEILKSQLDSLLGLYHLLDWFAVDESNEVDPEF

SARLTGIKLEMEPSLSFYNKARNYATKKPYSVEKFKLNFQMPTLASGWDVNKEKNNGAILFVKNGLY

YLGIMPKQKGRYKALSFEPTEKTSEGFDKMYYDYFPDAAKMIPKCSTQLKAVTAHFQTHTTPILLSNNF

IEPLEITKEIYDLNNPEKEPKKFQTAYAGGYREALCKWIDFTRDFLSKYTKTTSIDLSSLRPSSQYKDLGE

YYAELNPLLYHISFQRIAEKEIMDAVETGKLYLFQIYNKDFAKGHHGKPNLHTLYWTGLFSPENLAKTS

IKLNGQAELFYRPKSRMKRMAHRLGEKMLNKKLKDQKTPIPDTLYQELYDYVNHRLSHDLSDEARAL

LPNVITKEVSHEIIKDRRFTSDKFFFHVPITLNYQAANSPSKFNQRVNAYLKEHPETPIIGIDRGERNLIYIT

VIDSTGKILEQRSLNTIQQFDYQKKLDNREKERVAARQAWSVVGTIKDLKQGYLSQVIHEIVDLMIHYQ

AVVVLENLNFGFKSKRTGIAEKAVYQQFEKMLIDKLNCLVLKDYPAEKVGGVLNPYQLTDQFTSFAK

MGTQSGFLFYVPAPYTSKIDPLTGFVDPFVWKTIKNHESRKHFLEGFDFLHYDVKTGDFILHFKMNRNL

SFQRGLPGFMPAWDIVFEKNETQFDAKGTPFIAGKRIVPVIENHRFTGRYRDLYPANELIALLEEKGIVF

RDGSNILPKLLENDDSHAIDTMVALIRSVLQMRNSNAATGEDYINSPVRDLNGVCFDSRFQNPEWPMD

ADANGAYHIALKGQLLLNHLKESKDLKLQNGISNQDWLAYIQELRN
```

In some embodiments, the guide nucleotide sequence-programmable DNA-binding protein domain of the present disclosure has no requirements for a PAM sequence. One example of such a guide nucleotide sequence-programmable DNA-binding protein may be an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at gDNA site. In contrast to Cas9, the NgAgo-gDNA system does not require a protospacer-adjacent motif (PAM). Using a nuclease inactive NgAgo (dNgAgo) can greatly expand the bases or codons that may be targeted. The characterization and use of NgAgo have been described in Gao et al., *Nat Biotechnol.* *Epub* 2016 May 2. PubMed PMID: 27136078; Swarts et al., *Nature.* 507(7491) (2014):258-61; and Swarts et al., *Nucleic Acids Res.* 43(10) (2015):5120-9, each of which are incorporated herein by reference. The sequence of *Natronobacterium gregoryi* Argonaute is provided in SEQ ID NO: 270.

```
Wild type Natronobacterium gregoryi Argonaute
                                              (SEQ ID NO: 270)
MTVIDLDSTTTADELTSGHTYDISVTLTGVYDNTDEQHPRMSLAFEQDNG

ERRYITLWKNTTPKDVFTYDYATGSTYIFTNIDYEVKDGYENLTATYQTT
```

VENATAQEVGTTDEDETFAGGEPLDHHLDDALNETPDDAETESDSGHVMT

SFASRDQLPEWTLHTYTLTATDGAKTDTEYARRTLAYTVRQELYTDHDAA

PVATDGLMLLTPEPLGETPLDLDCGVRVEADETRTLDYTTAKDRLLAREL

VEEGLKRSLWDDYLVRGIDEVLSKEPVLTCDEFDLHERYDLSVEVGHSGR

AYLHINFRHRFVPKLTLADIDDDNIYPGLRVKTTYRPRRGHIVWGLRDEC

ATDSLNTLGNQSVVAYHRNNQTPINTDLLDAIEAADRRVVETRRQGHGDD

AVSFPQELLAVEPNTHQIKQFASDGFHQQARSKTRLSASRCSEKAQAFAE

RLDPVRLNGSTVEFSSEFFTGNNEQQLRLLYENGESVLTFRDGARGAHPD

ETFSKGIVNPPESFEVAVVLPEQQADTCKAQWDTMADLLNQAGAPPTRSE

TVQYDAFSSPESISLNVAGAIDPSEVDAAFVVLPPDQEGFADLASPTETY

DELKKALANMGIYSQMAYFDRFRDAKIFYTRNVALGLLAAAGGVAFTTEH

AMPGDADMFIGIDVSRSYPEDGASGQINIAATATAVYKDGTILGHSSTRP

QLGEKLQSTDVRDIMKNAILGYQQVTGESPTHIVIHRDGFMNEDLDPATE

FLNEQGVEYDIVEIRKQPQTRLLAVSDVQYDTPVKSIAAINQNEPRATVA

TFGAPEYLATRDGGGLPRPIQIERVAGETDIETLTRQVYLLSQSHIQVHN

STARLPITTAYADQASTHATKGYLVQTGAFESNVGFL

Also provided herein are Cas9 variants that have relaxed PAM requirements (PAMless Cas9). PAMless Cas9 exhibits an increased activity on a target sequence that does not include a canonical PAM (e.g., NGG) at its 3'-end as compared to *Streptococcus pyogenes* Cas9 as provided by SEQ ID NO: 1, e.g., increased activity by at least 5-fold, at least 10-fold, at least 50-fold, at least 100-fold, at least 500-fold, at least 1,000-fold, at least 5,000-fold, at least 10,000-fold, at least 50,000-fold, at least 100,000-fold, at least 500,000-fold, or at least 1,000,000-fold. Such Cas9 variants that have relaxed PAM requirements are described in U.S. Provisional Applications, U.S. Ser. No. 62/245,828, 62/279,346, 62/311,763, 62/322,178, and 62/357,332, each of which is incorporated herein by reference. In some embodiments, the dCas9 or Cas9 nickase useful in the present disclosure may further comprise mutations that relax the PAM requirements, e.g., mutations that correspond to A262T, K294R, S409I, E480K, E543D, M694I, or E1219V in SEQ ID NO: 1.

Other non-limiting, exemplary Cas9 variants (including dCas9, Cas9 nickase, and Cas9 variants with alternative PAM requirements) suitable for use in the nucleobase editors useful in the present disclosure and their respective sequences are provided below.

VRER-nCas9 (D10A/D1135V/G1218R/R1335E/T1337R) *S. pyogenes* Cas9 Nickase
(SEQ ID NO: 2426)
MDKK<u>YSIGLAIGTNSVGWAVITDEYKVPSKKFKVLGNTDRHSIKKNLIGALLFDSGETA</u>EATRLKRTAR

RRYTRRKNRICYLQEIFSNEMAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLLKALVRQQLPEK

YKEIFFDQSKNGYAGYIDGGASQLEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGA

SAQSFIERMTNFDKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILDFLKSDGFANRN

FMQLIHDDSLTFKEDIQKAQVSGQG<u><u>DSLHEHIANLAGSPAIKKGILQTVKVVDELVKVMGRHKPENIVI

EMARE</u></u>NQTTQKGQKNSRERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKKMKNYWRQLLNAKLITQRK

<u><u>FDNLTKAERGGLSELDKAGFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMPQVNIVKKTEVQ

T</u></u>GGFSKESILPKRNSDKLIARKKDWDPKKYGGFVSPTVAYSVLVVAKVEKGKSKKLKSVKELLGITIME

RSSFEKNPIDFLEAKGYKEVKKDLIIKLPKYSLFELENGRKRMLASARELQKGNELALPSKYVNFLYLA

SHYEKLKGSPEDNEQKQLFVEQHKHYLDEIIEQISEFSKRVILADANLDKVLSAYNKHRDKPIREQAENI

IHLFTLTNLGAPAAFKYFDTTIDRKEYRSTKEVLDATLIHQSITGLYETRIDLSQLGGD (single underline: HNH domain; double underline: RuvC domain)

VQR-nCas9 (D10A/D1135V/R1335Q/T1337R) S. pyogenes Cas9 Nickase
(SEQ ID NO: 2427)
MDKK<u>YSIGLAIGTNSVGWAVITDEYKVPSKKFKVLGNTDRHSIKKNLIGALLFDSGET</u>AEATRLKRTAR
RRYTRRKNRICYLQEIFSNEMAKVDDSFFHRLEESFLVEEDKKHERHPIFGNIVDEVAYHEKYPTIYHLR
KKLVDSTDKADLRLIYLALAHMIKFRGHFLIEGDLNPDNSDVDKLFIQLVQTYNQLFEENPINASGVDA
KAILSARLSKSRRLENLIAQLPGEKKNGLFGNLIALSLGLTPNFKSNFDLAEDAKLQLSKDTYDDDLDN
LLAQIGDQYADLFLAAKNLSDAILLSDILRVNTEITKAPLSASMIKRYDEHHQDLTLLKALVRQQLPEK
YKEIFFDQSKNGYAGYIDGGASQLEFYKFIKPILEKMDGTEELLVKLNREDLLRKQRTFDNGSIPHQIHL
GELHAILRRQEDFYPFLKDNREKIEKILTFRIPYYVGPLARGNSRFAWMTRKSEETITPWNFEEVVDKGA
SAQSFIERMTNFDKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEENEDILEDIVLTLT
LFEDREMIEERLKTYAHLFDDKVMKQLKRRRYTGWGRLSRKLINGIRDKQSGKTILDFLKSDGFANRN
FMQLIHDDSLTFKEDIQKAQVSGQG<u>DSLHEHIANLAGSPAIKKGILQTVKVVDELVKVMGRHKPENIVI
EMAR</u>ENQTTQKGQ<u>KNSRERMKRIEEGIKELGSQILKEHPVENTQLQNEKLYLYYLQNGRDMYVDQEL
DINRLSDYDVDHIVPQSFLKDDSIDNKVLTRSDKNRGKSDNVPSEEVVKKMKNYWRQLLNAKLITQRK
FDNLTK</u>AERGG<u>LSELDKAGFIKRQLVETRQITKHVAQILDSRMNTKYDENDKLIREVKVITLKSKLVSD
FRKDFQFYKVREINNYHHAHDAYLNAVVGTALIKKYPKLESEFVYGDYKVYDVRKMIAKSEQEIGKA
TAKYFFYSNIMNFFKTEITLANGEIRKRPLIETNGETGEIVWDKGRDFATVRKVLSMPQVNIVKKTEVQ
TGGFSKESILPKRNSDKLIARKKDWDPKKYGGF</u>VSPTVAYSVLVVAKVEKGKSKKLKSVKELLGITIME
RSSFEKNPIDFLEAKGYKEVKKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVLSAYNKHRDKPIREQAENI
IHLFTLTNLGAPAAFKYFDTTIDRKQYRSTKEVLDATLIHQSITGLYETRIDLSQLGGD
(single underline: HNH domain; double underline: RuvC domain)

EQR-nCas9 (D10A/D1135E/R1335Q/T1337R) S. pyogenes Cas9 Nickase
(SEQ ID NO: 2428)
MDKK<u>YSIGLAIGTNSVGWAVITDEYKVPSKKFKVLGNTDRHSIKKNLIGALLFDSGET</u>AEATRLKRTAR
RRYTRRKNRICYLQEIFSNEMAKVDDSFFHRLEESFLVEEDKKHERHPIFGNIVDEVAYHEKYPTIYHLR
KKLVDSTDKADLRLIYLALAHMIKFRGHFLIEGDLNPDNSDVDKLFIQLVQTYNQLFEENPINASGVDA
KAILSARLSKSRRLENLIAQLPGEKKNGLFGNLIALSLGLTPNFKSNFDLAEDAKLQLSKDTYDDDLDN
LLAQIGDQYADLFLAAKNLSDAILLSDILRVNTEITKAPLSASMIKRYDEHHQDLTLLKALVRQQLPEK
YKEIFFDQSKNGYAGYIDGGASQLEFYKFIKPILEKMDGTEELLVKLNREDLLRKQRTFDNGSIPHQIHL
GELHAILRRQEDFYPFLKDNREKIEKILTFRIPYYVGPLARGNSRFAWMTRKSEETITPWNFEEVVDKGA
SAQSFIERMTNFDKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEENEDILEDIVLTLT
LFEDREMIEERLKTYAHLFDDKVMKQLKRRRYTGWGRLSRKLINGIRDKQSGKTILDFLKSDGFANRN
FMQLIHDDSLTFKEDIQKAQVSGQG<u>DSLHEHIANLAGSPAIKKGILQTVKVVDELVKVMGRHKPENIVI
EMAR</u>ENQTTQKGQ<u>KNSRERMKRIEEGIKELGSQILKEHPVENTQLQNEKLYLYYLQNGRDMYVDQEL
DINRLSDYDVDHIVPQSFLKDDSIDNKVLTRSDKNRGKSDNVPSEEVVKKMKNYWRQLLNAKLITQRK
FDNLTK</u>AERGG<u>LSELDKAGFIKRQLVETRQITKHVAQILDSRMNTKYDENDKLIREVKVITLKSKLVSD
FRKDFQFYKVREINNYHHAHDAYLNAVVGTALIKKYPKLESEFVYGDYKVYDVRKMIAKSEQEIGKA
TAKYFFYSNIMNFFKTEITLANGEIRKRPLIETNGETGEIVWDKGRDFATVRKVLSMPQVNIVKKTEVQ
TGGFSKESILPKRNSDKLIARKKDWDPKKYGGF</u>ESPTVAYSVLVVAKVEKGKSKKLKSVKELLGITIME -continued

RSSFEKNPIDFLEAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKHRDKPIREQAENI

IHLFTLTNLGAPAAFKYFDTTIDRKQYRSTKEVLDATLIHQSITGLYETRIDLSQLGGD (single underline: HNH domain; double underline: RuvC domain)

KKH-nCas9 (D10A/E782K/N968K/R1015H) *S. aureus* Cas9 Nickase
(SEQ ID NO: 268)
MKRNYILGLAIGITSVGYGIIDYETRDVIDAGVRLFKEANVENNEGRRSKRGARRLKRRRRHRIQRVKK

LLFDYNLLTDHSELSGINPYEARVKGLSQKLSEEEFSAALLHLAKRRGVHNVNEVEEDTGNELSTKEQI

SRNSKALEEKYVAELQLERLKKDGEVRGSINRFKTSDYVKEAKQLLKVQKAYHQLDQSFIDTYIDLLE

TRRTYYEGPGEGSPFGWKDIKEWYEMLMGHCTYFPEELRSVKYAYNADLYNALNDLNNLVITRDENE

KLEYYEKFQIIENVFKQKKKPTLKQIAKEILVNEEDIKGYRVTSTGKPEFTNLKVYHDIKDITARKEIIEN

AELLDQIAKILTIYQSSEDIQEELTNLNSELTQEEIEQISNLKGYTGTHNLSLKAINLILDELWHTNDNQIA

IFNRLKLVPKKVDLSQQKEIPTTLVDDFILSPVVKRSFIQSIKVINAIIKKYGLPNDIIIELAREKNSKDAQK

MINEMQKRNRQTNERIEEIIRTTGKENAKYLIEKIKLHDMQEGKCLYSLEAIPLEDLLNNPFNYEVDHIIP

RSVSFDNSFNNKVLVKQEENSKKGNRTPFQYLSSSDSKISYETFKKHILNLAKGKGRISKTKKEYLLEER

DINRFSVQKDFINRNLVDTRYATRGLMNLLRSYFRVNNLDVKVKSINGGFTSFLRRKWKFKKERNKGY

KHHAEDALIIANADFIFKEWKKLDKAKKVMENQMFEEKQAESMPEIETEQEYKEIFITPHQIKHIKDFK

DYKYSHRVDKKPNRKLINDTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAKKLKKISNQAEFIASFYKN

DLIKINGELYRVIGVNNDLLNRIEVNMIDITYREYLENMNDKRPPHIIKTIASKTQSIKKYSTDILGNLYE

VKSKKHPQIIKKG

*Streptococcus thermophilus* CRISPR1 Cas9 (St1Cas9) Nickase (D9A)
(SEQ ID NO: 269)
MSDLVLGLAIGIGSVGVGILNKVTGEIIHKNSRIFPAAQAENNLVRRTNRQGRRLTRKKHRRVLNRL

FEESGLITDFTKISINLNPYQLRVKGLTDELSNEELFIALKNMVKHRGISYLDDASDDGNSSIGDYAQIVK

ENSKQLETKTPGQIQLERYQTYGQLRGDFTVEKDGKKHRLINVFPTSAYRSEALRILQTQQEFNPQITDE

FINRYLEILTGKRKYYHGPGNEKSRTDYGRYRTSGETLDNIFGILIGKCTFYPDEFRAAKASYTAQEFNL

LNDLNNLTVPTETKKLSKEQKNQIINYVKNEKAMGPAKLFKYIAKLLSCDVADIKGYRIDKSGKAEIHT

FEAYRKMKTLETLDIEQMDRETLDKLAYVLTLNTEREGIQEALEHEFADGSFSQKQVDELVQFRKANS

SIFGKGWHNFSVKLMMELIPELYETSEEQMTILTRLGKQKTTSSSNKTKYIDEKLLTEEIYNPVVAKSVR

QAIKIVNAAIKEYGDFDNIVIEMARETNEDDEKKAIQKIQKANKDEKDAAMLKAANQYNGKAELPHSV

FHGHKQLATKIRLWHQQGERCLYTGKTISIHDLINNSNQFEVDHILPLSITFDDSLANKVLVYATANQE

KGQRTPYQALDSMDDAWSFRELKAFVRESKTLSNKKKEYLLTEEDISKFDVRKKFIERNLVDTRYASR

VVLNALQEHFRAHKIDTKVSVVRGQFTSQLRRHWGIEKTRDTYHHHAVDALIIAASSQLNLWKKQKN

TLVSYSEDQLLDIETGELISDDEYKESVFKAPYQHFVDTLKSKEFEDSILFSYQVDSKFNRKISDATIYAT

RQAKVGKDKADETYVLGKIKDIYTQDGYDAFMKIYKKDKSKFLMYRHDPQTFEKVIEPILENYPNKQI

NEKGKEVPCNPFLKYKEEHGYIRKYSKKGNGPEIKSLKYYDSKLGNHIDITPKDSNNKVVLQSVSPWR

ADVYFNKTTGKYEILGLKYADLQFEKGTGTYKISQEKYNDIKKKEGVDSDSEFKFTLYKNDLLLVKDT

ETKEQQLFRFLSRTMPKQKHYVELKPYDKQKFEGGEALIKVLGNVANSGQCKKGLGKSNISIYKVRTD

VLGNQHIIKNEGDKPKLDF

-continued

Streptococcus thermophilus CRISPR3Cas9 (St3Cas9) Nickase (D10A)
(SEQ ID NO: 2429)

```
MTKPYSIGLAIGTNSVGWAVITDNYKVPSKKMKVLGNTSKKYIKKNLLGVLLFDSGITAEGRRLKRTA

RRRYTRRRNRILYLQEIFSTEMATLDDAFFQRLDDSFLVPDDKRDSKYPIFGNLVEEKVYHDEFPTIYHL

RKYLADSTKKADLRLVYLALAHMIKYRGHFLIEGEFNSKNNDIQKNFQDFLDTYNAIFESDLSLENSKQ

LEEIVKDKISKLEKKDRILKLFPGEKNSGIFSEFLKLIVGNQADFRKCFNLDEKASLHFSKESYDEDLETL

LGYIGDDYSDVFLKAKKLYDAILLSGFLTVTDNETEAPLSSAMIKRYNEHKEDLALLKEYIRNISLKTYN

EVFKDDTKNGYAGYIDGKTNQEDFYVYLKNLLAEFEGADYFLEKIDREDFLRKQRTFDNGSIPYQIHLQ

EMRAILDKQAKFYPFLAKNKERIEKILTFRIPYYVGPLARGNSDFAWSIRKRNEKITPWNFEDVIDKESS

AEAFINRMTSFDLYLPEEKVLPKHSLLYETFNVYNELTKVRFIAESMRDYQFLDSKQKKDIVRLYFKDK

RKVTDKDIIEYLHAIYGYDGIELKGIEKQFNSSLSTYHDLLNIINDKEFLDDSSNEAIIEEIIHTLTIFEDRE

MIKQRLSKFENIFDKSVLKKLSRRHYTGWGKLSAKLINGIRDEKSGNTILDYLIDDGISNRNFMQLIHDD

ALSFKKKIQKAQIIGDEDKGNIKEVVKSLPGSPAIKKGILQSIKIVDELVKVMGGRKPESIVVEMARENQ

YTNQGKSNSQQRLKRLEKSLKELGSKILKENIPAKLSKIDNNALQNDRLYLYYLQNGKDMYTGDDLDI

DRLSNYDIDHIIPQAFLKDNSIDNKVLVSSASNRGKSDDFPSLEVVKKRKTFWYQLLKSKLISQRKFDNL

TKAERGGLLPEDKAGFIQRQLVETRQITKHVARLLDEKFNNKKDENNRAVRTVKIITLKSTLVSQFRKD

FELYKVREINDFHHAHDAYLNAVIASALLKKYPKLEPEFVYGDYPKYNSFRERKSATEKVYFYSNIMNI

FKKSISLADGRVIERPLIEVNEETGESVWNKESDLATVRRVLSYPQVNVVKKVEEQNHGLDRGKPKGL

FNANLSSKPKPNSNENLVGAKEYLDPKKYGGYAGISNSFAVLVKGTIEKGAKKKITNVLEFQGISILDRI

NYRKDKLNFLLEKGYKDIELIIELPKYSLFELSDGSRRMLASILSTNNKRGEIHKGNQIFLSQKFVKLLYH

AKRISNTINENHRKYVENHKKEFEELFYYILEFNENYVGAKKNGKLLNSAFQSWQNHSIDELCSSFIGPT

GSERKGLFELTSRGSAADFEFLGVKIPRYRDYTPSSLLKDATLIHQSVTGLYETRIDLAKLGEG
```

In some embodiments, the nucleobase editors useful in the present disclosure comprises: (i) a guide nucleotide sequence-programmable DNA-binding protein domain; and (ii) a deaminase domain. In some embodiments, the deaminase domain of the fusion protein is a cytosine deaminase. In some embodiments, the deaminase is an APOBEC1 deaminase. In some embodiments, the deaminase is a rat APOBEC1. In some embodiments, the deaminase is a human APOBEC1. In some embodiments, the deaminase is an APOBEC2 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a Lamprey CDA1 (pmCDA1). In some embodiments, the deaminase is a human APOBEC3G or a functional fragment thereof. In some embodiments, the deaminase is an APOBEC3G variant comprising mutations corresponding to the D316R/D317R mutations in the human APOBEC3G. Exemplary, non-limiting cytosine deaminase sequences that may be used in accordance with the methods of the present disclosure are provided in Example 1 below.

In some embodiments, the cytosine deaminase is a wild type deaminase or a deaminase as set forth in SEQ ID NOs: 271-292, 303, and 2483-2494. In some embodiments, the cytosine deaminase domains of the fusion proteins provided herein include fragments of deaminases or proteins homologous to a deaminase. For example, in some embodiments, a deaminase domain comprises a fragment of any of the amino acid sequences set forth in any of SEQ ID NOs: 271-292, 303, and 2483-2494. In some embodiments, a deaminase domain comprises an amino acid sequence homologous to the amino acid sequence set forth in any of SEQ ID NOs: 271-292, 303, and 2483-2494, or an amino acid sequence homologous to a fragment of the amino acid sequence set forth in any of SEQ ID NOs: 271-292, 303, and 2483-2494. In some embodiments, proteins comprising a deaminase, fragments of a deaminase, or homologs of a deaminase are referred to as "deaminase variants." A deaminase variant shares homology to a deaminase, or a fragment thereof. For example, a deaminase variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to a wild type deaminase or a deaminase as set forth in any of SEQ ID NOs: 271-292, 303, and 2483-2494. In some embodiments, the deaminase variant comprises a fragment of the deaminase, such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of a wild type deaminase or a deaminase as set forth in any of SEQ ID NOs: 271-292, 303, and 2483-2494. In some embodiments, the cytosine deaminase is at least at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to an APOBEC3G variant as set forth in SEQ ID NO: 291 or SEQ ID NO: 292, and comprises mutations corresponding to the D316E/D317R mutations in SEQ ID NO: 290.

In some embodiments, the cytosine deaminase domain is fused to the N-terminus of the guide nucleotide sequence-programmable DNA-binding protein domain. For example, the fusion protein may have an architecture of $NH_2$-[cytosine deaminase]-[guide nucleotide sequence-programmable DNA-binding protein domain]-COOH. The "]-[" used in the general architecture above indicates the presence of an optional linker sequence. The term "linker," as used herein, refers to a chemical group or a molecule linking two molecules or moieties, e.g., two domains of a fusion protein, such as, for example, a dCas9 domain and a cytosine deaminase domain. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

In some embodiments, the cytosine deaminase domain and the Cas9 domain are fused to each other via a linker. Various linker lengths and flexibilities between the deaminase domain (e.g., APOBEC1) and the Cas9 domain can be employed (e.g., ranging from very flexible linkers of the form $(GGGS)_n$ (SEQ ID NO: 2430), $(GGGGS)_n$ (SEQ ID NO: 308), $(GGS)_n$ (SEQ ID NO: 2467), and $(G)_n$ (SEQ ID NO: 2498) to more rigid linkers of the form $(EAAAK)_n$ (SEQ ID NO: 309), SGSETPGTSESATPES (SEQ ID NO: 310)) (see, e.g., Guilinger et, al., Nat. Biotechnol. 2014; 32(6): 577-82; the entire contents are incorporated herein by reference), $(SGGS)_n$SGSETPGTSESATPES$(SGGS)_n$ (SEQ ID NO: 2481), $(XP)_n$, or a combination of any of these, wherein X is any amino acid, and n is independently an integer between 1 and 30, in order to achieve the optimal length for deaminase activity for the specific application. In some embodiments, n is independently 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30, or, if more than one linker or more than one linker motif is present, any combination thereof. In some embodiments, the linker comprises a $(GGS)_n$(SEQ ID NO: 2467) motif, wherein n is 1, 2, 3, 4, 5, 6, 7, 8, 9, 10, 11, 12, 13, 14, or 15. In some embodiments, the linker comprises a $(GGS)_n$(SEQ ID NO: 2467) motif, wherein n is 1, 3, or 7. In some embodiments, the linker comprises the amino acid sequence SGSETPGTSESATPES (SEQ ID NO: 310), also referred to as the XTEN linker. In some embodiments, the linker comprises an amino acid sequence selected from the group including, but not limited to, AGVF (SEQ ID NO: 2499), GFLG (SEQ ID NO: 2500), FK, AL, ALAL (SEQ ID NO: 2501), and ALALA (SEQ ID NO: 2502). In some embodiments, suitable linker motifs and configurations include those described in Chen et al., Fusion protein linkers: property, design and functionality. Adv Drug Deliv Rev. 2013; 65(10):1357-69, which is incorporated herein by reference. In some embodiments, the linker comprises any of the following amino acid sequences: VPFLLEPDNINGKTC (SEQ ID NO: 311), GSAGSAAGSGEF (SEQ ID NO: 312), SIVAQLSRPDPA (SEQ ID NO: 313), MKIIEQLPSA (SEQ ID NO: 314), VRHKLKRVGS (SEQ ID NO: 315), GHGTGSTGSGSS (SEQ ID NO: 316), MSRPDPA (SEQ ID NO: 317), GSAGSAAGSGEF (SEQ ID NO: 312), SGSETPGTSESA (SEQ ID NO: 318), SGSETPGTSESATPEGGSGGS (SEQ ID NO: 319), or GGSM (SEQ ID NO: 320). Any linker provided under the "Linkers" section may be used.

In some embodiments, the nucleobase editor comprises a guide nucleotide sequence-programmable DNA-binding protein domain and an apolipoprotein B mRNA-editing complex 1 (APOBEC1) deaminase domain, where the deaminase domain is fused to the N-terminus of the napDNAbp domain via a linker comprising the amino acid sequence SGSETPGTSESATPES (SEQ ID NO: 310). In some embodiments, the a guide nucleotide sequence-programmable DNA-binding protein domain comprises the amino acid sequence of any of the a guide nucleotide sequence-programmable DNA-binding protein domains provided herein. In some embodiments, the deaminase is rat APOBEC1 (SEQ ID NO: 288). In some embodiments, the deaminase is human APOBEC1 (SEQ ID NO: 286). In some embodiments, the deaminase is pmCDA1 (SEQ ID NO: 289). In some embodiments, the deaminase is human APOBEC3G (SEQ ID NO: 279). In some embodiments, the deaminase is a human APOBEC3G variant of any one of (SEQ ID NOs: 290-292). In some embodiments, the fusion protein comprises a guide nucleotide sequence-programmable DNA-binding protein domain and an apolipoprotein B mRNA-editing complex 1 catalytic polypeptide-like 3G (APOBEC3G) deaminase domain, wherein the deaminase domain is fused to the N-terminus of the a guide nucleotide sequence-programmable DNA-binding protein domain via a linker of any length or composition (e.g., an amino acid sequence, a peptide, a polymer, or a bond). In some embodiments, the linker comprises the amino acid sequence SGSETPGTSESATPES (SEQ ID NO: 310). In some embodiments, the linker comprises the amino acid sequence $(SGGS)_2$SGSETPGTSESATPES$(SGGS)_2$ (SEQ ID NO: 2482).

In some embodiments, the fusion protein comprises a guide nucleotide sequence-programmable DNA-binding protein domain and a cytidine deaminase 1 (CDA1) deaminase domain, wherein the deaminase domain is fused to the N-terminus of the guide nucleotide sequence-programmable DNA-binding protein domain via a linker comprising the amino acid sequence SGSETPGTSESATPES (SEQ ID NO: 310). In some embodiments, the linker comprises the amino acid sequence $(SGGS)_2$SGSETPGTSESATPES$(SGGS)_2$ (SEQ ID NO: 2482). In some embodiments, the guide nucleotide sequence-programmable DNA-binding protein domain comprises the amino acid sequence of any of the guide nucleotide sequence-programmable DNA-binding protein domains provided herein.

In some embodiments, the fusion protein comprises a guide nucleotide sequence-programmable DNA-binding protein and an activation-induced cytidine deaminase (AID) deaminase domain, where the deaminase domain is fused to the N-terminus of the guide nucleotide sequence-programmable DNA-binding protein domain via a linker comprising the amino acid sequence SGSETPGTSESATPES (SEQ ID NO: 310). In some embodiments, the linker comprises the amino acid sequence (SGGS)$_2$SGSETPGTSESATPES (SGGS)$_2$ (SEQ ID NO: 2482). In some embodiments, the guide nucleotide sequence-programmable DNA-binding protein comprises the amino acid sequence of any of the guide nucleotide sequence-programmable DNA-binding protein domains provided herein.

Some aspects of the disclosure are based on the recognition that certain configurations of a guide nucleotide sequence-programmable DNA-binding protein, and a cytidine deaminase domain fused by a linker are useful for efficiently deaminating target cytidine residues. Other aspects of this disclosure relate to the recognition that a nucleobase editing fusion protein with an apolipoprotein B mRNA-editing complex 1 (APOBEC1) deaminase domain fused to the N-terminus of a guide nucleotide sequence-programmable DNA-binding protein via a linker comprising the amino acid sequence SGSETPGTSESATPES (SEQ ID NO: 310) was capable of efficiently deaminating target nucleic acids in a double stranded DNA target molecule. In some embodiments, the fusion protein comprises a guide nucleotide sequence-programmable DNA-binding protein domain and an apolipoprotein B mRNA-editing complex 1 (APOBEC1) deaminase domain, where the deaminase domain is fused to the N-terminus of the napDNAbp via a linker comprising the amino acid sequence SGSETPGTS-ESATPES (SEQ ID NO: 310). In some embodiments, the fusion protein comprises a guide nucleotide sequence-programmable DNA-binding protein domain and an apolipoprotein B mRNA-editing complex 1 (APOBEC1) deaminase domain, where the deaminase domain is fused to the N-terminus of the napDNAbp via a linker comprising the amino acid sequence (SGGS)$_2$SGSETPGTSESATPES(SGGS)$_2$ (SEQ ID NO: 2482).

To successfully edit the desired target C base, the linker between Cas9 and APOBEC may be optimized, as described in Komor et al., Nature, 533, 420-424 (2016), which is incorporated herein by reference. The numbering scheme for base editing is based on the predicted location of the target C within the single-stranded stretch of DNA (R-loop) displaced by a programmable guide RNA sequence occurring when a DNA-binding domain (e.g. Cas9, nCas9, dCas9) binds a genomic site. Conveniently, the sequence immediately surrounding the target C also matches the sequence of the guide RNA. The numbering scheme for base editing is based on a standard 20-mer programmable sequence, and defines position "21" as the first DNA base of the PAM sequence, resulting in position "1" assigned to the first DNA base matching the 5'-end of the 20-mer programmable guide RNA sequence. Therefore, for all Cas9 variants, position "21" is defined as the first base of the PAM sequence (e.g. NGG, NGAN, NGNG, NGAG, NGCG, NNGRRT, NGRRN, NNNRRT, NNNGATT, NNAGAA, NAAAC). When a longer programmable guide RNA sequence is used (e.g. 21-mer) the 5'-end bases are assigned a decreasing negative number starting at "−1". For other DNA-binding domains that differ in the position of the PAM sequence, or that require no PAM sequence, the programmable guide RNA sequence is used as a reference for numbering. A 3-aa linker results in a 2-5 base editing window (e.g., positions 2, 3, 4, or 5 relative to the PAM sequence at position 21). A 9-aa linker results in a 3-6 base editing window (e.g., positions 3, 4, 5, or 6 relative to the PAM sequence at position 21). A 16-aa linker (e.g., the SGSETPGTSESAT-PES (SEQ ID NO: 310) linker) results in a 4-7 base editing window (e.g., positions 4, 5, 6, or 7 relative to the PAM sequence at position 21). A 21-aa linker results in a 5-8 base editing window (e.g., positions 5, 6, 7, or 8 relative to the PAM sequence at position 21). Each of these windows can be useful for editing different targeted C bases. For example, the targeted C bases may be at different distances from the adjacent PAM sequence, and by varying the linker length, the precise editing of the desired C base is ensured. One skilled in the art, based on the teachings of CRISPR/Cas9 technology in the art, and in particular the teachings of e.g., in U.S. Pat. No. 9,068,179, US Patent Application Publications US 2015/0166980, published Jul. 18, 2015, US 2015/0166981, published Jul. 18, 2015; US 2015/0166982, published Jul. 18, 2015; US 2015/0166984, published Jul. 18, 2015; and US 2015/0165054, published Jul. 18, 2015; and US Provisional Applications, U.S. Ser. No. 62/245,828, filed Oct. 23, 2015; 62/279,346, filed Jan. 15, 2016; 62/311,763, filed Mar. 22, 2016; 62/322,178, filed Apr. 13, 2016, 62/357,352, filed Jun. 30, 2016, U.S. Pat. No. 62/370,700, filed Aug. 3, 2016; 62/398,490, filed Sep. 22, 2016; 62/408,686, filed Oct. 14, 2016; PCT Application PCT/US2016/058344, filed Oct. 22, 2016, U.S. patent application Ser. No. 15/311,852, filed Oct. 22, 2016; and in Komor et al., Nature, Programmable editing of a target base in genomic DNA without double-stranded DNA cleavage, 533, 420-424 (2016), the entire contents of each of which are incorporated herein by reference, will be able to determine the window of editing for his/her purpose, and properly design the linker of the cytosine deaminase-dCas9 protein for the precise targeting of the desired C base.

To successfully edit the desired target C base, appropriate Cas9 domain may be selected to attach to the deaminase domain (e.g., APOBEC1), since different Cas9 domains may lead to different editing windows. For example, APOBEC1-XTEN-SaCas9n-UGI gives a 1-12 base editing window (e.g., positions 1, 2, 3, 4, 5, 6, 7, 8, 9, 10, 11, or 12 relative to the NNNRRT PAM sequence in positions 20-26). One skilled in the art, based on the teachings of CRISPR/Cas9 technology in the art, will be able to determine the editing window and properly determine the required Cas9 homolog and linker attached to the cytosine deaminase for the precise targeting of the desired C base.

In some embodiments, the fusion protein useful in the present disclosure further comprises a uracil glycosylase inhibitor (UGI) domain. A "uracil glycosylase inhibitor" refers to a protein that inhibits the activity of uracil-DNA glycosylase. The C to T base change induced by deamination results in a U:G heteroduplex, which triggers cellular DNA-repair response. Uracil DNA glycosylase (UDG) catalyzes removal of U from DNA in cells and initiates base excision repair, with reversion of the U:G pair to a C:G pair as the most common outcome. Thus, such cellular DNA-repair response may be responsible for the decrease in nucleobase editing efficiency in cells. Uracil DNA Glycosylase Inhibitor (UGI) is known in the art to block UDG activity. As described in Komor et al., Nature (2016), fusing a UGI domain to the cytidine deaminase-dCas9 fusion protein reduced the activity of UDG and significantly enhanced editing efficiency.

Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. J. Biol. Chem. 264: 1163-1171(1989); Lundquist et al., Site-directed mutagenesis and characterization of uracil-DNA glycosylase inhibitor protein. Role of specific carboxylic amino acids in complex formation with *Escherichia coli* uracil-DNA glycosylase. *J. Biol. Chem.* 272:21408-21419(1997); Ravishankar et al., X-ray analysis of a complex of *Escherichia coli* uracil DNA glycosylase (EcUDG) with a proteinaceous inhibitor. The structure elucidation of a prokaryotic UDG. *Nucleic Acids Res.* 26:4880-4887(1998); and Putnam et al., Protein mimicry of DNA from crystal structures of the uracil-DNA glycosylase inhibitor protein and its complex with *Escherichia coli* uracil-DNA glycosylase. *J. Mol. Biol.* 287:331-346(1999), each of which is incorporated herein by reference. In some embodiments, the UGI domain comprises the amino acid sequence of SEQ ID NO: 304 without the N-terminal methionine (M). In some embodiments, the UGI protein comprises the following amino acid sequence:

```
Bacillus phage PBS2 (Bacteriophage PBS2)Uracil-DNA
glycosylase inhibitor
                                      (SEQ ID NO: 304)
MTNLSDIIEKETGKQLVIQESILMLPEEVEEVIGNKPESDILVHTAYDES
TDENVMLLTSDAPEYKPWALVIQDSNGENKIKML
```

In some embodiments, the UGI protein comprises a wild type UGI or a UGI as set forth in SEQ ID NO: 304. In some embodiments, the UGI proteins useful in the present disclosure include fragments of UGI and proteins homologous to a UGI or a UGI fragment. For example, in some embodiments, a UGI protein comprises a fragment of the amino acid sequence set forth in SEQ ID NO: 304. In some embodiments, a UGI comprises an amino acid sequence homologous to the amino acid sequence set forth in SEQ ID NO: 304 or an amino acid sequence homologous to a fragment of the amino acid sequence set forth in SEQ ID NO: 304. In some embodiments, proteins comprising UGI or fragments of UGI or homologs of UGI or UGI fragments are referred to as "UGI variants." A UGI variant shares homology to UGI, or a fragment thereof. For example a UGI variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to a wild type UGI or a UGI as set forth in SEQ ID NO: 304. In some embodiments, the UGI variant comprises a fragment of UGI, such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type UGI or the UGI as set forth in SEQ ID NO: 304.

It should be appreciated that additional proteins may be uracil glycosylase inhibitors. For example, other proteins that are capable of inhibiting (e.g., sterically blocking) a uracil-DNA glycosylase base-excision repair enzyme are within the scope of this disclosure. In some embodiments, a uracil glycosylase inhibitor is a protein that binds DNA. In some embodiments, a uracil glycosylase inhibitor is a protein that binds single-stranded DNA. For example, a *Erwinia tasmaniensis* single-stranded binding protein may also inhibit the activity of uracil glycosylase. In some embodiments, the single-stranded binding protein comprises the amino acid sequence (SEQ ID NO: 305). In some embodiments, a uracil glycosylase inhibitor is a protein that binds uracil. In some embodiments, a uracil glycosylase inhibitor is a protein that binds uracil in DNA. In some embodiments, a uracil glycosylase inhibitor is a catalytically inactive uracil DNA-glycosylase protein. In some embodiments, a uracil glycosylase inhibitor is a catalytically inactive uracil DNA-glycosylase protein that does not excise uracil from the DNA. For example, a uracil glycosylase inhibitor is a UdgX. In some embodiments, the UdgX comprises the amino acid sequence (SEQ ID NO: 306). As another example, a uracil glycosylase inhibitor is a catalytically inactive UDG. In some embodiments, a catalytically inactive UDG comprises the amino acid sequence (SEQ ID NO: 307). It should be appreciated that other uracil glycosylase inhibitors would be apparent to the skilled artisan and are within the scope of this disclosure.

```
Erwinia tasmaniensis SSB (themostable single-stranded DNA binding protein)
                                                              (SEQ ID NO: 305)
MASRGVNKVILVGNLGQDPEVRYMPNGGAVANITLATSESWRDKQTGETKEKTEWHRVVLFGKLAE

VAGEYLRKGSQVYIEGALQTRKWTDQAGVEKYTTEVVVNVGGTMQMLGGRSQGGGASAGGQNGGS

NNGWGQPQQPQGGNQFSGGAQQQARPQQQPQQNNAPANNEPPIDFDDDIP

UdgX (binds to uracil in DNA but does not excise)
                                                              (SEQ ID NO: 306)
MAGAQDFVPHTADLAELAAAAGECRGCGLYRDATQAVFGAGGRSARIMMIGEQPGDKEDLAGLPFV

GPAGRLLDRALEAADIDRDALYVTNAVKHFKFTRAAGGKRRIHKTPSRTEVVACRPWLIAEMTSVEPD

VVVLLGATAAKALLGNDFRVTQHRGEVLHVDDVPGDPALVATVHPSSLLRGPKEERESAFAGLVDDL

RVAADVRP

UDG (catalytically inactive human UDG, binds to ura-
cil in DNA but does not excise)
                                                              (SEQ ID NO: 307)
MIGQKTLYSFFSPSPARKRHAPSPEPAVQGTGVAGVPLESGDAAAIPAKKAPAGQEEPGTPPSSPLSALQ

LDRIQRNKAAALLRLAARNVPVGFGESWKKHLSGEFGKPYFIKLMGFVAEERKHYTVYPPPHQVFTW

TQMCDIKDVKVVILGQEPYHGPNQAHGLCFSVQRPVPPPPSLENIYKELSTDIEDFVHPGHGDLSGWAK

QGVLLLNAVLTVRAHQANSHKERGWEQFTDAVVSWLNQNSNGLVFLLWGSYAQKKGSAIDRKRHH

VLQTAHPSPLSVYRGFFGCRHFSKTNELLQKSGKKPIDWKEL
```

In some embodiments, the UGI domain is fused to the C-terminus of the dCas9 domain in the fusion protein. Thus, the fusion protein would have an architecture of NH₂-[cytosine deaminase]-[guide nucleotide sequence-programmable DNA-binding protein domain]-[UGI]-COOH. In some embodiments, the UGI domain is fused to the N-terminus of the cytosine deaminase domain. As such, the fusion protein would have an architecture of NH₂-[UGI]-[cytosine deaminase]-[guide nucleotide sequence-programmable DNA-binding protein domain]-COOH. In some embodiments, the UGI domain is fused between the guide nucleotide sequence-programmable DNA-binding protein domain and the cytosine deaminase domain. As such, the fusion protein would have an architecture of NH₂-[cytosine deaminase]-[UGI]-[guide nucleotide sequence-programmable DNA-binding protein domain]-COOH. The linker sequences useful in the present disclosure may also be used for the fusion of the UGI domain to the cytosine deaminase-dCas9 fusion proteins.

In some embodiments, the fusion protein comprises the structure:

[cytosine deaminase]-[optional linker sequence]-[guide nucleotide sequence-programmable DNA binding protein]-[optional linker sequence]-[UGI];

[cytosine deaminase]-[optional linker sequence]-[UGI]-[optional linker sequence]-[guide nucleotide sequence-programmable DNA binding protein];

[UGI]-[optional linker sequence]-[cytosine deaminase]-[optional linker sequence]-[guide nucleotide sequence-programmable DNA binding protein];

[UGI]-[optional linker sequence]-[guide nucleotide sequence-programmable DNA binding protein]-[optional linker sequence]-[cytosine deaminase];

[guide nucleotide sequence-programmable DNA binding protein]-[optional linker sequence]-[cytosine deaminase]-[optional linker sequence]-[UGI]; or

[guide nucleotide sequence-programmable DNA binding protein]-[optional linker sequence]-[UGI]-[optional linker sequence]-[cytosine deaminase].

In some embodiments, the fusion protein used in the present disclosure comprises the structure:

[cytosine deaminase]-[optional linker sequence]-[Cas9 nickase]-[optional linker sequence]-[UGI];

[cytosine deaminase]-[optional linker sequence]-[UGI]-[optional linker sequence]-[Cas9 nickase];

[UGI]-[optional linker sequence]-[cytosine deaminase]-[optional linker sequence]-[Cas9 nickase];

[UGI]-[optional linker sequence]-[Cas9 nickase]-[optional linker sequence]-[cytosine deaminase];

[Cas9 nickase]-[optional linker sequence]-[cytosine deaminase]-[optional linker sequence]-[UGI]; or

[Cas9 nickase]-[optional linker sequence]-[UGI]-[optional linker sequence]-[cytosine deaminase].

In some embodiments, fusion proteins useful in the present disclosure further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the UGI protein. In some embodiments, the NLS is fused to the C-terminus of the UGI protein. In some embodiments, the NLS is fused to the N-terminus of the guide nucleotide sequence-programmable DNA-binding protein domain. In some embodiments, the NLS is fused to the C-terminus of the guide nucleotide sequence-programmable DNA-binding protein domain. In some embodiments, the NLS is fused to the N-terminus of the cytosine deaminase. In some embodiments, the NLS is fused to the C-terminus of the deaminase. In some embodiments, the NLS is fused to the fusion protein via one or more linkers. In some embodiments, the NLS is fused to the fusion protein without a linker. Non-limiting, exemplary NLS sequences may be PKKKRKV (SEQ ID NO: 2431) or MDSLLMNRRKFLYQFKNVRWAKGRRETYLC (SEQ ID NO: 2432).

In some embodiments, any of the fusion proteins provided herein comprise a second UGI domain. Fusion proteins comprising two UGI domains are described in U.S. Provisional Application No., U.S. Ser. Nos. 62/475,830, filed Mar. 23, 2017; 62/490,587; 62/511,934, filed May 26, 2017; 62/551,951, filed Aug. 30, 2017; and Komor et al. (2017) Improved Base Excision Repair Inhibition and Bateriophage Mu Gam Protein Yields C:G-to-T:A base editors with higher efficiency and product purity. *Sci Adv*, 3: eaao4774; the entire contents of which is incorporated by reference herein. In some embodiments, the second UGI domain comprises a wild-type UGI or a UGI as set forth in SEQ ID NO: 304. In some embodiments, the UGI proteins provided herein include fragments of UGI and proteins homologous to a UGI or a UGI fragment. For example, in some embodiments, the second UGI domain comprises a fragment of the amino acid sequence set forth in SEQ ID NO: 304. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 304. In some embodiments, the second UGI domain comprises an amino acid sequence homologous to the amino acid sequence set forth in SEQ ID NO: 304 or an amino acid sequence homologous to a fragment of the amino acid sequence set forth in SEQ ID NO: 304. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 304. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 304.

In some embodiments, the fusion protein comprises the structure:

[deaminase]-[optional linker sequence]-[dCas9]-[optional linker sequence]-[first UGI]-[optional linker sequence]-[second UGI];

[deaminase]-[optional linker sequence]-[Cas9 nickase]-[optional linker sequence]-[first UGI]-[optional linker sequence]-[second UGI]; or

[deaminase]-[optional linker sequence]-[Cas9]-[optional linker sequence]-[first UGI]-[optional linker sequence]-[second UGI].

In some embodiments, the nucleobase editor comprises a guide nucleotide sequence-programmable DNA-binding protein domain and an apolipoprotein B mRNA-editing complex 1 (APOBEC1) deaminase domain, wherein the deaminase domain is fused to the N-terminus of the guide nucleotide sequence-programmable DNA-binding protein domain via a linker comprising the amino acid sequence (SGGS)₂SGSETPGTSESATPES(SGGS)₂ (SEQ ID NO: 2482). In some embodiments, the a guide nucleotide sequence-programmable DNA-binding protein domain comprises the amino acid sequence of any of the a guide nucleotide sequence-programmable DNA-binding protein domains provided herein. In some embodiments, the deaminase is rat APOBEC1 (SEQ ID NO: 288). In some embodiments, the deaminase is human APOBEC1 (SEQ ID NO: 286). In some embodiments, the deaminase is a human APOBEC3G variant of any one of (SEQ ID NOs: 290-292). In some embodiments, the nucleobase editor comprises a first UGI domain fused to the C-terminus of a guide nucleotide sequence-programmable DNA-binding protein domain via a linker comprising the amino acid sequence (GGS)ₙ (SEQ ID NO: 2467), wherein n is 3. In some embodiments, the nucleobase editor comprises a second UGI domain fused to the C-terminus of a first UGI domain via a linker comprising the amino acid sequence (GGS)ₙ(SEQ ID NO: 2467), wherein n is 3.

In some embodiments, the fusion protein comprises the amino acid sequence of SEQ ID NO: 2495. In some embodiments, the fusion protein comprises an amino acid sequence that is at least 70%, at least 75%, at least 80%, at least 85%, at least 90%, at least 95%, at least 96%, at least 97%, at least 98%, at least 99%, or at least 99.5% identical to the amino acid sequence as set forth in SEQ ID NO: 2495.

In some embodiments, any of the fusion proteins provided herein may further comprise a Gam protein. The term "Gam protein," as used herein, refers generally to proteins capable of binding to one or more ends of a double strand break of a double stranded nucleic acid (e.g., double stranded DNA). In some embodiments, the Gam protein prevents or inhibits degradation of one or more strands of a nucleic acid at the site of the double strand break. In some embodiments, a Gam protein is a naturally-occurring Gam protein from bacteriophage Mu, or a non-naturally occurring variant thereof. Fusion proteins comprising Gam proteins are described in Komor et al. (2017) Improved Base Excision Repair Inhibition and Bateriophage Mu Gam Protein Yields C:G-to-T:A base editors with higher efficiency and product purity. *Sci Adv,* 3: eaao4774; the entire contents of which is incorporated by reference herein. In some embodiments, the Gam protein comprises an amino acid sequence that is at least 70%, at least 75%, at least 80%, at least 85%, at least 90%, at least 92%, at least 95%, at least 96%, at least 97%, at least 98%, at least 99%, or at least 99.5% identical to the amino acid sequence provided by SEQ ID NO: 2496. In some embodiments, the Gam protein comprises the amino acid sequence of SEQ ID NO: 2496. In some embodiments, the fusion protein (e.g., BE4-Gam of SEQ ID NO: 2497) comprises a Gam protein, wherein the Cas9 domain of BE4 is replaced with any of the Cas9 domains provided herein.

Gam from bacteriophage Mu:
(SEQ ID NO: 2496)
AKPAKRIKSAAAAYVPQNRDAVITDIKRIGDLQREASRLETEMNDAIAEI

TEKFAARIAPIKTDIETLSKGVQGWCEANRDELTNGGKVKTANLVTGDVS

WRVRPPSVSIRGMDAVMETLERLGLQRFIRTKQEINKEAILLEPKAVAGV

AGITVKSGIEDFSIIPFEQEAGI

BE4-Gam:
(SEQ ID NO: 2497)
MAKPAKRIKSAAAAYVPQNRDAVITDIKRIGDLQREASRLETEMNDAIAE

ITEKFAARIAPIKTDIETLSKGVQGWCEANRDELINGGKVKTANLVTGDV

SWRVRPPSVSIRGMDAVMETLERLGLQRFIRTKQEINKEAILLEPKAVAG

VAGITVKSGIEDFSIIPFEQEAGISGSETPGTSESATPESSSETGPVAVD

PTLRRRIEPHEFEVFFDPRELRKETCLLYEINWGGRHSIWRHTSQNTNKH

VEVNFIEKFTTERYFCPNTRCSITWFLSWSPCGECSRAITEFLSRYPHVT

LFIYIARLYHHADPRNRQGLRDLISSGVTIQIMTEQESGYCWRNFVNYSP

SNEAHWPRYPHLWVRLYVLELYCIILGLPPCLNILRRKQPQLTFFTIALQ

SCHYQRLPPHILWATGLKSGGSSGGSSGSETPGTSESATPESSGGSSGGS

DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGDSGGSGGSGGSTNLSDIIEKETGKQLVIQESILM

LPEEVEEVIGNKPESDILVHTAYDESTDENVMLLTSDAPEYKPWALVIQD

SNGENKIKMLSGGSGGSGGSTNLSDIIEKETGKQLVIQESILMLPEEVEE

-continued

VIGNKPESDILVHTAYDESTDENVMLLTSDAPEYKPWALVIQDSNGENKI

KMLSGGSPKKKRK

Linkers

In certain embodiments, linkers may be used to link any of the protein or protein domains described herein. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-110, 110-120, 120-130, 130-140, 140-150, or 150-200 amino acids in length. Longer or shorter linkers are also contemplated. In some embodiments, a linker comprises the amino acid sequence SGSETPGTSESATPES (SEQ ID NO: 310), which may also be referred to as the XTEN linker. In some embodiments, a linker comprises the amino acid sequence SGGS (SEQ ID NO: 37). In some embodiments, a linker comprises (SGGS)n (SEQ ID NO: 2468), (GGGS)n (SEQ ID NO: 2430), (GGGGS)n (SEQ ID NO: 308), (G)n (SEQ ID NO: 2498), (EAAAK)n (SEQ ID NO: 40), (GGS)n (SEQ ID NO: 2467), SGSETPGTSESATPES (SEQ ID NO: 310), or (XP)n motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15. In some embodiments, a linker comprises SGSETPGTSESATPES (SEQ ID NO: 10), and SGGS (SEQ ID NO: 37). In some embodiments, a linker comprises SGGSSGSETPGTSESAT-PESSGGS (SEQ ID NO: 384). In some embodiments, a linker comprises SGGSSGGSSGSETPGTSESAT-PESSGGSSGGS (SEQ ID NO: 385). In some embodiments, a linker comprises (SEQ ID NO: 386)
GGSGGSPGSPAGSPTSTEEGTSESATPESGPGTSTEPSEGSAPGSPAGS
PTSTEEGTSTEPSEGSAPGTSTEPSEGSAPGTSESATPESGPGSEPATS
GGSGGS.

Nucleobase Editor/gRNA Complexes

Some aspects of the present disclosure provide nucleobase editors associated with a guide nucleotide sequence (e.g., a guide RNA or gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as a single RNA species comprise two domains: (1) a domain that shares homology to a target nucleic acid (e.g., and directs binding of the Cas9 complex to the target); and (2) a domain that binds the Cas9 protein. In some embodiments, domain (2) corresponds to a sequence known as a tracrRNA and comprises a stem-loop structure. For example, in some embodiments, domain (2) is identical or homologous to a tracrRNA as provided in Jinek et al., *Science* 337:816-821(2012), which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases And Uses Thereof," and U.S. Provisional Patent Application, U.S. Ser. No. 61/874,746, filed Sep. 6, 2013, entitled "Delivery System For Functional Nucleases," each of which is incorporated herein by reference. The gRNA comprises a nucleotide sequence that complements a target site, which mediates binding of the nuclease/RNA complex to said target site, providing the sequence specificity of the nuclease:RNA complex. These proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al. *Science* 339, 819-823 (2013); Mali, P. et al. *Science* 339, 823-826 (2013); Hwang, W. Y. et al. *Nature Biotechnology* 31, 227-229 (2013); Jinek, M. et al. eLife 2, e00471 (2013); Dicarlo, J. E. et al. *Nucleic acids research* (2013); Jiang, W. et al. *Nature biotechnology* 31, 233-239 (2013); each of which is incorporated herein by reference). In particular, examples of guide nucleotide sequences (e.g., sgRNAs) that may be used to target the fusion proteins useful in the present disclosure to its target sequence to deaminate the targeted C bases are described in Komor et al., *Nature*, 533, 420-424 (2016), which is incorporated herein by reference.

The specific structure of the guide nucleotide sequences (e.g., sgRNAs) depends on its target sequence and the relative distance of a PAM sequence downstream of the target sequence. One skilled in the art will understand that no unifying structure of guide nucleotide sequence is given, because the target sequences are different for each and every C targeted to be deaminated.

However, the present disclosure provides guidance on how to design the guide nucleotide sequence, e.g., a sgRNA, so that one skilled in the art may use such teachings to target a sequence of interest. A gRNA typically comprises a tracrRNA framework allowing for Cas9 binding, and a guide sequence, which confers sequence specificity to fusion proteins disclosed herein. In some embodiments, the guide RNA comprises a structure 5'-[guide sequence]-tracrRNA-3'. Non-limiting, exemplary tracrRNA sequences are shown in Table 13.

In some embodiments, the guide RNA is about 15-100 nucleotides long and comprises a sequence of at least 10 contiguous nucleotides that is complementary to a target

TABLE 13 tracrRNA othologues and sequences

| Organism | tracrRNA sequence | SEQ ID NO. |
|---|---|---|
| S. pyogenes | GUUUAAGAGCUAUGCUGGAAAGCCACGGUGAAAAGUUCAACUAUUGCCUGAUCGGAAUAAAUUUGAACGAUACGACAGUCGGUGCUUUUUUU | 322 |
| S. pyogenes | GUUUAAGAGCUAGAAAUAGCAAGUUUAAAUAAGGCUAGUCCGUUAUCAACUUGAAAAAGUGGCACCGAGUCGGUGCUUUUUU | 323 |
| S. thermophilus CRISPR1 | GUUUUUGUACUCUCAAGAUUCAAUAAUCUUGCAGAAGCUACAAAGAUAAGGCUUCAUGCCGAAAUCAACACCCUGUCAUUUUAUGGCAGGGUGUUUU | 324 |
| S. thermophilus CRISPR3 | GUUUUAGAGCUGUGUUGUUUGUUAAAACAACACAGCGAGUUAAAAUAAGGCUUAGUCCGUACUCAACUUGAAAAGGUGGCACCGAUUCGGUGUUUUU | 325 |
| C. jejuni | AAGAAAUUUAAAAAGGGACUAAAAUAAAGAGUUUGCGGGACUCUGCGGGGUUACAAUCCCCUAAAACCGCUUUU | 326 |
| F. novicida | AUCUAAAAUUAUAAAUGUACCAAAUAAUUAAUGCUCUGUAAUCAUUUAAAAGUAUUUUGAACGGACCUCUGUUUGACACGUCUGAAUAACUAAAA | 327 |
| S. thermophilus2 | UGUAAGGGACGCCUUACACAGUUACUUAAAUCUUGCAGAAGCUACAAAGAUAAGGCUUCAUGCCGAAAUCAACACCCUGUCAUUUUAUGGCAGGGUGUUUUCGUUAUUU | 328 |
| M. mobile | UGUAUUUCGAAAUACAGAUGUACAGUUAAGAAUACAUAAGAAUGAUACAUCACUAAAAAAAGGCUUUAUGCCGUAACUACUACUUAUUUUCAAAAUAAGUAGUUUUUUUU | 329 |
| L. innocua | AUUGUUAGUAUUCAAAAUAACAUAGCAAGUUAAAAUAAGGCUUUGUCCGUUAUCAACUUUUAAUUAAGUAGCGCUGUUUCGGCGCUUUUUUU | 330 |
| S. pyogenes | GUUGGAACCAUUCAAAACAGCAUAGCAAGUUAAAAUAAGGCUAGUCCGUUAUCAACUUGAAAAAGUGGCACCGAGUCGGUGCUUUUUUU | 331 |
| S. mutans | GUUGGAAUCAUUCGAAACAACACAGCAAGUUAAAAUAAGGCAGUGAUUUUAAUCCAGUCCGUACACAACUUGAAAAAGUGCGCACCGAUUCGGUGCUUUUUUAUUU | 332 |
| S. thermophilus | UUGUGGUUUGAAACCAUUCGAAACAACACAGCGAGUUAAAAUAAGGCUUAGUCCGUACUCAACUUGAAAAGGUGGCACCGAUUCGGUGUUUUUUU | 333 |
| N. meningitidis | ACAUAUUGUCGCACUGCGAAAUGAGAACCGUUGCUACAAUAAGGCCGUCUGAAAAGAUGUGCCGCAACGCUCUGCCCCUUAAAGCUUCUGCUUUAAGGGGCA | 334 |
| P. multocida | GCAUAUUGUUGCACUGCGAAAUGAGAGACGUUGCUACAAUAAGGCUUCUGAAAAGAAUGACCGUAACGCUCUGCCCCUUGUGAUUCUUAAUUGCAAGGGGCAUCGUUUUU | 335 |

The guide sequence of the gRNA comprises a sequence that is complementary to the target sequence. The guide sequence is typically about 20 nucleotides long. For example, the guide sequence may be approximately 15-25 nucleotides long. In some embodiments, the guide sequence is 15, 16, 17, 18, 19, 20, 21, 22, 23, 24, or 25 nucleotides long. In some embodiments, the guide sequence is more than 25 nucleotides long. Such suitable guide RNA sequences typically comprise guide sequences that are complementary to a nucleic sequence within 50 nucleotides upstream or downstream of the target nucleotide to be edited.

In some embodiments, the guide RNA is about 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence.

To edit the genes involved in pain propagation (e.g., ion channels in DRG neurons) using the methods described herein, the nucleobase editor and/or the guide nucleotide sequence is introduced into the cell (e.g., a DRG neuron) where the editing is to occur. In some embodiments, nucleic acid molecules (e.g., expression vectors) encoding the nucleobase editors and/or the guide nucleotide sequences are delivered into the cell, resulting in co-expression of the nucleobase editor(s) and/or the guide nucleotide sequence(s) in the cell. The nucleic acid molecules encoding the nucleobase editors and/or the guide nucleotide sequences may be delivered into the cell using any methods known in the art, e.g., transfection (e.g., transfection mediated by cationic liposomes), and transduction (e.g., via viral infection). In some embodiments, a nucleobase editor/gRNA complex is delivered. Methods of delivering a protein to a cell are familiar to those skilled in the art. For example, the nucleobase editor in complex with a gRNA may be associated with a supercharged or cell-penetrating protein or peptide, which facilitates its entry into a cell (e.g., as described in PCT Application Publication WO 2010/129023, published Nov. 11, 2010, and US Patent Application Publication US 2015/0071906, published Mar. 12, 2015, each of which is incorporated herein by reference). In some embodiments, the isolated nucleobase editor in complex with a gRNA is delivered to a cell using a cationic transfection reagent, e.g., the Lipofectamine CRISPRMAX Cas9 Transfection Reagent from Thermofisher Scientific. In some embodiments, the nucleobase editor and the gRNA may be delivered separately. Other suitable delivery methods may also be used, e.g., AAV mediated gene transfer. Strategies for delivery a genome editing agent (e.g., the nucleobase editor) using AAV have been described, e.g., in Zetsche et al., *Nature Biotechnology* 33, 139-142 (2015), incorporated herein by reference. Delivery of a split Cas9 using AAV has also been described, e.g., in Truong et al., *Nucl. Acids Res.* 43, 6450 (2016), and U.S. Provisional Application 62/408,575, filed Oct. 14, 2016, each of which is incorporated herein by reference.

Figure 2:
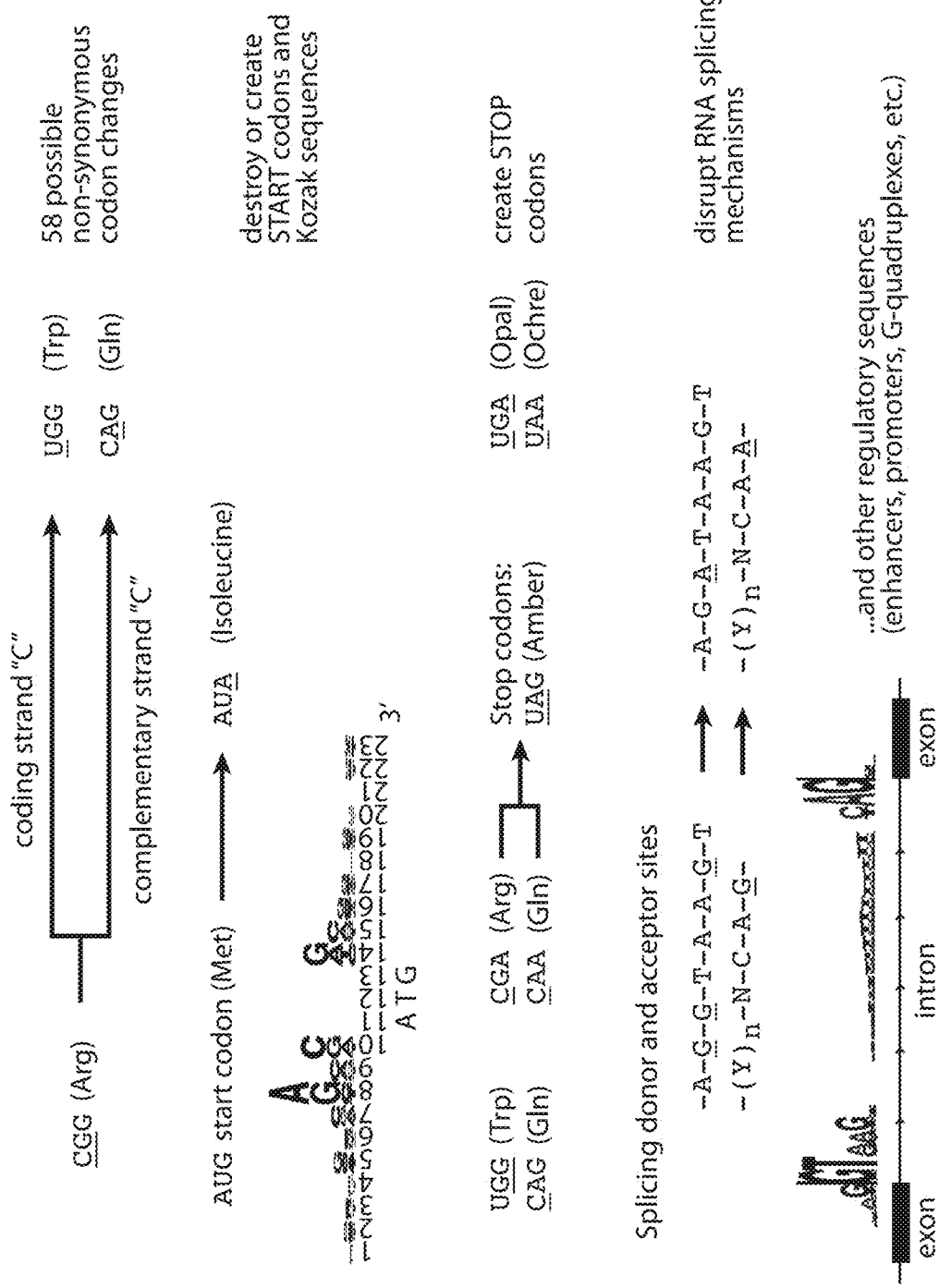
FIG. 2 shows exemplary, non-limiting representative examples of genome modifications using cytidine deaminase base editing, which can be applied to modify DRG neuron genes and afferent pain signals.

In some embodiments, the genome editing agents (e.g., nucleobase editors) are delivered to neurons (e.g., DRG neurons) using neurotropic viral delivery vectors. Using neurotropic viral delivery vectors to deliver the genome editing agent enables genome editing treatments aimed at the site(s) of pain, despite the fact that the genetic material within the nuclei of DRG neurons is quite distant and indistinguishable from unrelated cells within each ganglion (e.g., as shown in FIG. 2).

In some embodiments, the neurotropic viral delivery vector is derived from a Herpes Simplex Virus 1 (HSV-1), which targets nerve endings in vivo and usurps retrograde axon transport to move the viral DNA up to the cell body of DRG neurons (e.g., as described in Smith et al., *Annual Review of Microbiology*, 66, 153-176, 2012, which is incorporated herein by reference). In addition, HSV-1 derived vectors allows packaging a large double-stranded DNA genome (>150 kbp), which can easily accommodate an expression construct for any programmable genome-editing enzyme (4-5 kbp), multiple guide-RNAs, and regulatory sequences. In some embodiments, the nucleotide sequences encoding the nucleobase editor and/or the gRNA is inserted into a neurotropic viral delivery vector (e.g., a HSV-1 derived vector) by replacing non-essential genes of the virus (e.g., HSV-1). Non-limiting examples of neurotropic viruses that may be used for the delivery of the genome editing agents described herein include the broader herpesviridae group, varicella-zoster, pseudorabies, cytomegalovirus, Epstein-Barr viruses, encephalitis viruses, polio, coxsackie, echo, mumps, measles, and rabies viruses. Evolved AAV that are neurotropic have also been described (e.g., Nature Biotechnology 34, 204-209 (2016), which is incorporated herein by reference) and may be used in accordance with the present disclosure. Delivery of a split Cas9 using AAV has also been described, e.g., in Truong et al., *Nucl. Acids Res.* 43, 6450 (2016), and US Provisional Application, U.S. Ser. No. 62/408,575, filed Oct. 14, 2016, each of which is incorporated herein by reference.

In some embodiments, the expression of the genome editing agents (e.g., nucleobase editors and/or gRNAs) is driven by a neuron-specific promoter, such that the genome editing agent is expressed specifically in neurons. Non-limiting examples of neuron-specific promoters that may be used in accordance with the present disclosure include: human synapsin I (SYN) promoter (e.g., as described in Li et al., *Proc Natl Acad Sci USA* 1993; 90: 1460-1464, incorporated herein by reference), mouse calcium/calmodulin-dependent protein kinase II (CaMKII) promoter (e.g., as described in Mayford et al., *Proc Natl Acad Sci USA* 1996; 93: 13250-13255, incorporated herein by reference), rat tubulin alpha I (Tal) promoter (e.g., as described in Gloster et al., *J Neurosci* 1994; 14: 7319-7330, incorporated herein by reference), rat neuron-specific enolase (NSE) promoter (e.g., as described in Forss-Petter et al, Neuron 1990; 5: 187-197, incorporated herein by reference), and human platelet-derived growth factor-beta chain (PDGF) promoter (e.g., as described in Sasahara et al, Cell 1991; 64: 217-227, incorporated herein by reference). In some embodiments, the gRNA sequence is engineered such that it targets the genome editing agent (e.g., the nucleobase editor) to a target gene encoding an ion channel that is only expressed in neurons, thus minimizing or eliminating the effect on other types of tissues (i.e., enhanced specificity).

Compositions

Aspects of the present disclosure relate to compositions that may be used for pain suppression. Such compositions comprise any of the genome editing agents (e.g., the nucleobase editor and/or gRNA) or nucleic acids (e.g., DNA, RNA) encoding the genome editing agent (e.g., a neurotropic viral delivery vector) described herein. In some embodiments, the composition is administered to a subject for pain suppression.

In some embodiments, the composition further comprises a pharmaceutically acceptable carrier. As used here, the term "pharmaceutically acceptable carrier" means a pharmaceutically acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). Some examples of materials which can serve as pharmaceutically acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides, carbohydrates, and amino acids; (23) serum component, such as serum albumin, HDL, and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

Suitable routes of administrating the composition for pain suppression include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the composition for pain suppression is administered locally to the site of pain (e.g., via tropical administration or injection). In some embodiments, the localized volume of treatment is 1 $\mu m^3$ to 1 $dm^3$ (e.g., 1, 10 $\mu m^3$, 100 $\mu m^3$, 1000 $\mu m^3$, 10000 $\mu m^3$, or 1 $dm^3$).

In some embodiments, the composition for pain suppression is administered to a subject by injection, by means of a catheter, by means of a suppository, or by means of an implant, the implant being of a porous, non-porous, or gelatinous material, including a membrane, such as a sialastic membrane, or a fiber.

In other embodiments, the compositions for pain suppression are delivered in a controlled release system. In one embodiment, a pump may be used (see, e.g., Langer, 1990, *Science* 249:1527-1533; Sefton, 1989, *CRC Crit. Ref. Biomed. Eng.* 14:201; Buchwald et al., 1980, *Surgery* 88:507; Saudek et al., 1989, *N. Engl. J. Med.* 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, *Macromol. Sci. Rev. Macromol. Chem.* 23:61. See also Levy et al., 1985, *Science* 228:190; During et al., 1989, *Ann. Neurol.* 25:351; Howard et al., 1989, *J. Neurosurg.* 71:105.) Other controlled release systems are discussed, for example, in Langer, supra.

In some embodiments, the composition is formulated in accordance with routine procedures as a composition adapted for intravenous or subcutaneous administration to a subject, e.g., a human. In some embodiments, compositions for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical is administered by injection, an ampoule of sterile water for injection or saline can be provided so that the ingredients can be mixed prior to administration.

A composition for systemic administration may be a liquid, e.g., sterile saline, lactated Ringer's or Hank's solution. In addition, the pharmaceutical composition can be in solid forms and re-dissolved or suspended immediately prior to use. Lyophilized forms are also contemplated.

The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., *Gene Ther.* 1999, 6:1438-47). Positively charged lipids such as N-[1-(2,3-dioleoyloxi)propyl]-N,N,N-trimethyl-amoniummethyl-sulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The compositions of this disclosure may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the compositions of the present disclosure may be assembled into kits. In some embodiments, the kit comprises nucleic acid vectors for the expression of the genome-editing agents useful in the present disclosure. In some embodiments, the kit further comprises appropriate guide nucleotide sequences (e.g., gRNAs), or nucleic acid vectors for the expression of such guide nucleotide sequences, for targeting the nucleobase editor to the desired target sequence.

The kit described herein may include one or more containers housing components for performing the methods described herein and optionally instructions of uses. Any of the kit described herein may further comprise components needed for performing the assay methods. Each component of the kits, where applicable, may be provided in liquid form (e.g., in solution), or in solid form, (e.g., a dry powder). In certain cases, some of the components may be reconstitutable or otherwise processible (e.g., to an active form), for example, by the addition of a suitable solvent or other species (for example, water or certain organic solvents), which may or may not be provided with the kit.

In some embodiments, the kits may optionally include instructions and/or promotion for use of the components provided. As used herein, "instructions" can define a component of instruction and/or promotion, and typically involve written instructions on or associated with packaging of the disclosure. Instructions also can include any oral or electronic instructions provided in any manner such that a user will clearly recognize that the instructions are to be associated with the kit, for example, audiovisual (e.g., videotape, DVD, etc.), Internet, and/or web-based communications, etc. The written instructions may be in a form prescribed by a governmental agency regulating the manufacture, use, or sale of pharmaceuticals or biological products, which can also reflect approval by the agency of manufacture, use or sale for animal administration. As used herein, "promoted" includes all methods of doing business including methods of education, hospital and other clinical instruction, scientific inquiry, drug discovery or development, academic research, pharmaceutical industry activity including pharmaceutical sales, and any advertising or other promotional activity including written, oral and electronic communication of any form, associated with the disclosure. Additionally, the kits may include other components depending on the specific application, as described herein.

The kits may contain any one or more of the components described herein in one or more containers. The components may be prepared sterilely, packaged in a syringe and shipped refrigerated. Alternatively it may be housed in a vial or other container for storage. A second container may have other components prepared sterilely. Alternatively the kits may include the active agents premixed and shipped in a vial, tube, or other container.

The kits may have a variety of forms, such as a blister pouch, a shrink wrapped pouch, a vacuum sealable pouch, a sealable thermoformed tray, or a similar pouch or tray form, with the accessories loosely packed within the pouch, one or more tubes, containers, a box or a bag. The kits may be sterilized after the accessories are added, thereby allowing the individual accessories in the container to be otherwise unwrapped. The kits can be sterilized using any appropriate sterilization techniques, such as radiation sterilization, heat sterilization, or other sterilization methods known in the art. The kits may also include other components, depending on the specific application, for example, containers, cell media, salts, buffers, reagents, syringes, needles, a fabric, such as gauze, for applying or removing a disinfecting agent, disposable gloves, a support for the agents prior to administration, etc.

Therapeutics

The compositions described herein, may be administered to a subject in need thereof, in a therapeutically effective amount, for the suppression of pain. In some embodiments, the pain is chronic pain. "Chronic pain" is pain that lasts a long time. Types of pain that may be treated using the pain suppression strategies described herein include, without limitation: pain associated with a condition such as cancer pain, tumor pressure, bone metastasis, chemotherapy peripheral neuropathy, radiculopathy (sciatica, lumbar, cervical, failed back surgery syndrome), piriformis syndrome, phantom pain, arachnoiditis, fibromyalgia, facet joint mediated pain, sympathetically-mediated pain syndrome such as complex regional pain syndromes (crps), sacroiliac (si) joint mediated pain, meralgia paresthetica, localized myofacial pain syndromes-myofacial trigger points, diffuse myofacial pain syndrome, post-herpetic neuralgia, trigeminal neuralgia, glossopharyngeal neuralgia, scar pain (post-epesiotomy, post-hernia repair, post-surgery, post-radiotherapy), vulvodynia, vaginismus, levator ani syndrome, chronic prostatitis, interstitial cystitis, first bite syndrome, rheumatoid arthritis pain, osteoarthritis pain, atypical odontalgia, phantom tooth pain, neuropathic orofacial pain, and atypical facial pain, nerve block procedures (alternative to neurolytic, neurectomy, radiation, radiofrequency ablation). In some embodiments, the pain is neuropathic pain, allodynia, hyperalgesia, dysesthesia, causalgia, neuralgia, primary erythermalgia, or arthralgia.

A "therapeutically effective amount" as used herein refers to the amount of each therapeutic agent of the present disclosure required to confer therapeutic effect on the subject, either alone or in combination with one or more other therapeutic agents. Effective amounts vary, as recognized by those skilled in the art, depending on the particular condition being treated, the severity of the condition, the individual subject parameters including age, physical condition, size, gender and weight, the duration of the treatment, the nature of concurrent therapy (if any), the specific route of administration and like factors within the knowledge and expertise of the health practitioner. These factors are well known to those of ordinary skill in the art and can be addressed with no more than routine experimentation. It is generally preferred that a maximum dose of the individual components or combinations thereof be used, that is, the highest safe dose according to sound medical judgment. It will be understood by those of ordinary skill in the art, however, that a subject may insist upon a lower dose or tolerable dose for medical reasons, psychological reasons or for virtually any other reasons. Empirical considerations, such as the half-life, generally will contribute to the determination of the dosage.

Frequency of administration may be determined and adjusted over the course of therapy, and is generally, but not necessarily, based on treatment and/or suppression and/or amelioration and/or delay of a disease. Alternatively, sustained continuous release formulations of a genome-editing may be appropriate. Various formulations and devices for achieving sustained release are known in the art. In some embodiments, dosage is daily, every other day, every three days, every four days, every five days, or every six days. In some embodiments, dosing frequency is once every week, every 2 weeks, every 4 weeks, every 5 weeks, every 6 weeks, every 7 weeks, every 8 weeks, every 9 weeks, or every 10 weeks; or once every month, every 2 months, or every 3 months, or longer. The progress of this therapy is easily monitored by conventional techniques and assays.

The dosing regimen can vary over time. In some embodiments, for an adult subject of normal weight, doses ranging from about 0.01 to 1000 mg/kg may be administered. In some embodiments, the dose is between 1 to 200 mg. The particular dosage regimen, i.e., dose, timing and repetition, will depend on the particular subject and that subject's medical history, as well as the properties of the agents.

For the purpose of the present disclosure, the appropriate dosage of a genome-editing agent as described herein will depend on the specific agent (or compositions thereof) employed, the formulation and route of administration, the type and severity of the disease, whether the genome-editing agent is administered for preventive or therapeutic purposes, previous therapy, the subject's clinical history and response to the antagonist, and the discretion of the attending physician. Typically the clinician will administer a genome-editing agent until a dosage is reached that achieves the desired result.

As used herein, the term "treating" refers to the application or administration of a genome-editing agent described herein or a composition comprising such genome-editing agent to a subject in need thereof. Alleviating a disease includes delaying the development or progression of the disease, or reducing disease severity. Alleviating the disease does not necessarily require curative results.

"Development" or "progression" of a disease means initial manifestations and/or ensuing progression of the disease. Development of the disease can be detectable and assessed using standard clinical techniques as well known in the art. However, development also refers to progression that may be undetectable. For purpose of this disclosure, development or progression refers to the biological course of the symptoms. "Development" includes occurrence, recurrence, and onset. As used herein "onset" or "occurrence" of a disease includes initial onset and/or recurrence.

The term "parenteral" as used herein includes subcutaneous, intracutaneous, intravenous, intramuscular, intraarticular, intraarterial, intrasynovial, intrasternal, intrathecal, intralesional, and intracranial injection or infusion techniques. In addition, it can be administered to the subject via injectable depot routes of administration such as using 1-, 3-, or 6-month depot injectable or biodegradable materials and methods.

Without further elaboration, it is believed that one skilled in the art can, based on the above description, utilize the present disclosure to its fullest extent. The following specific embodiments are, therefore, to be construed as merely illustrative, and not limitative of the remainder of the disclosure in any way whatsoever. All publications cited herein are incorporated by reference for the purposes or subject matter referenced herein.

EXAMPLES

In order that the invention described herein may be more fully understood, the following examples are set forth. The synthetic examples described in this application are offered to illustrate the compounds and methods provided herein and are not to be construed in any way as limiting their scope.

Example 1: Guide Nucleotide Sequence-Programmable DNA-Binding Protein Domains, Deaminases, and Base Editors Non-limiting examples of suitable guide nucleotide sequence-programmable DNA-binding protein domain s are provided. The disclosure provides Cas9 variants, for example, Cas9 proteins from one or more organisms, which may comprise one or more mutations (e.g., to generate dCas9 or Cas9 nickase). In some embodiments, one or more of the amino acid residues, identified below by an asterek, of a Cas9 protein may be mutated. In some embodiments, the D10 and/or H840 residues of the amino acid sequence provided in SEQ ID NO: 1, or a corresponding mutation in any of the amino acid sequences provided in SEQ ID NOs: 11-260, are mutated. In some embodiments, the D10 residue of the amino acid sequence provided in SEQ ID NO: 1, or a corresponding mutation in any of the amino acid sequences provided in SEQ ID NOs: 11-260, is mutated to any amino acid residue, except for D. In some embodiments, the D10 residue of the amino acid sequence provided in SEQ ID NO: 1, or a corresponding mutation in any of the amino acid sequences provided in SEQ ID NOs: 11-260, is mutated to an A. In some embodiments, the H840 residue of the amino acid sequence provided in SEQ ID NO: 1, or a corresponding residue in any of the amino acid sequences provided in SEQ ID NOs: 11-260, is an H. In some embodiments, the H840 residue of the amino acid sequence provided in SEQ ID NO: 1, or a corresponding mutation in any of the amino acid sequences provided in SEQ ID NOs: 11-260, is mutated to any amino acid residue, except for H. In some embodiments, the H840 residue of the amino acid sequence provided in SEQ ID NO: 1, or a corresponding mutation in any of the amino acid sequences provided in SEQ ID NOs: 11-260, is mutated to an A. In some embodiments, the D10 residue of the amino acid sequence provided in SEQ ID NO: 1, or a corresponding residue in any of the amino acid sequences provided in SEQ ID NOs: 11-260, is a D.

A number of Cas9 sequences from various species were aligned to determine whether corresponding homologous amino acid residues of D10 and H840 of SEQ ID NO: 1 or SEQ ID NO: 11 can be identified in other Cas9 proteins, allowing the generation of Cas9 variants with corresponding mutations of the homologous amino acid residues. The alignment was carried out using the NCBI Constraint-based Multiple Alignment Tool (COBALT (accessible at st-va.ncbi.nlm.nih.gov/tools/cobalt), with the following parameters. Alignment parameters: Gap penalties −11,-1; End-Gap penalties −5,-1. CDD Parameters: Use RPS BLAST on; Blast E-value 0.003; Find Conserved columns and Recompute on. Query Clustering Parameters: Use query clusters on; Word Size 4; Max cluster distance 0.8; Alphabet Regular.

An exemplary alignment of four Cas9 sequences is provided below. The Cas9 sequences in the alignment are: Sequence 1 (S1): SEQ ID NO: 11 |WP_010922251| gi 499224711 | type II CRISPR RNA-guided endonuclease Cas9 [*Streptococcus pyogenes*]; Sequence 2 (S2): SEQ ID NO: 12 |WP_039695303 | gi 746743737 | type II CRISPR RNA-guided endonuclease Cas9 [*Streptococcus gallolyticus*]; Sequence 3 (S3): SEQ ID NO: 13 | WP_045635197 | gi 782887988 | type II CRISPR RNA-guided endonuclease Cas9 [*Streptococcus mitis*]; Sequence 4 (S4): SEQ ID NO: 14 |5AXW_A|gi 924443546| *Staphylococcus Aureus* Cas9. The HNH domain (bold and underlined) and the RuvC domain (boxed) are identified for each of the four sequences. Amino acid residues 10 and 840 in S1 and the homologous amino acids in the aligned sequences are identified with an asterisk following the respective amino acid residue.

```
S1    1  --MDKK-YSIGLD*IGTNSVGWAVITDEYKVESKKFKVLGNTDRESIKENLI--GALLEDSG--ETAEATRLKRTARRRYT    73
S2    1  --MTKKNYSIGLD*IGTNSVGWAVITDDYKVPAKKMKVIGNTDKKYIKENLL--GALLFDSG--ETAEATRLKRTARRRYT    74
S3    1  --M-KKGYSIGLD*IGTNSVGFAVITDDYKVESKEMEVLGNTDKRFIKKNLI--GALLFDEG--TTAEARRLKRTARRRYT    73
S4    1  GSHMKRNYILGLD*IGITSVGYGII--DYET----------------RDVIDAGVRIFKEANVENNEGRRSKRGARRLKR    61

S1   74  RRKNRICYLQEIFSNEMAKVDDSFFHRLEESFLVEEDKKHERHPIFGNIVDEVAYHEKYPTIYHLRKKLVDSTDKADLRL   153
S2   75  RRKNRLRYLQEIFANEIAKVDESFFQRLDESFLTDDDKTEDSHPIFGNKAEEDAYHQKFPTIYHLRKHLADSSEKADLRL   154
S3   74  RRKNRLRYLQEIFSEEMSKVDSSFFHRLDDSFLIPEDKRESKYPIFATLTEEKEYHKQFPTIYHLRKQLADSKEKTDLRL   153
S4   62  RRRHRIQRVKKLL-------------FDYNLLTD-------------------HSELSGINPYEARVKGLSQKLSEEE    107

S1  154  TYLALAHMIKFRGHFLIEGDLNPDNSDVDKLFIQLVQTYNQLFEENPINASGVDAKAILSARLSKSRRLENLIAQLPGEK   233
S2  155  VYLALAHMIKFRGHFLIEGELNAENTDVQKIFADFVGVYNRTFDDSHLSEITVDVASILTEKISKSRRLENLIKYYPTEK   234
S3  154  TYLALAHMIKYRGHFLYEEAFDIKNNDIQKIFNEFISIYDNTFEGSSLSGQNAQVEAIFTDKISKSAKRERVLKLFPDEK   233
S4  108  FSAALLHLAKRRG--------------------VHNVNEVEEDT-----------------------------------   131

S1  234  KNGLFGNLIALSLGLTPNEKSNFDLAEDAKLQLSKDTYDDDLDNLLAQIGDQYADLFLAAKNLSDAILLSDILRVNTEIT   313
S2  235  KNTLFGNLIALALGLQPNEKTNFKLSEDAKLQFSKDTYEEDLEELLGKIGDDYADLFTSAKNLYDAILLSGILTVDDNST   314
```

-continued
```
S3    234 STGLFSEFLKLIVGNQADFKKHFDLEDKAPLQFSKDTYDEDLENLLGQIGDDFTDLFVSAKKLYDAILLSGILTVTDPST  313
S4    132 -----GNELS-------------------TKEQISRN----------------------------------------  144

S1    314 KAPLSASMIKRYDEHHQDLTLLKALVRQQLPEKYKEIFFDQSKNGYAGYIDGGASQEEFYKFIKPILEKM--DGTEELLV  391
S2    315 KAPLSASMIKRYVEHHEDLEKLKEFIKANKSELYHDIFKDKNKNGYAGYIENGVKQDEFYKYLKNILSKIKIDGSDYFLD  394
S3    314 KAPLSASMIERYENHQNDLAALKQFIKNNLPEKYDEVFSDQSKDGYAGYIDGKTTQETFYKYIKNLLSKF--EGTDYFLD  391
S4    145 ----SKALEEKYVAELQ-------------------------------------------LERLKKDG-----      165

S1    392 KLNREDLLRKQRTFDNGSIPHQIHLGELHAILRRQEDFYPFLKDNREKIEKILTFRIPYYVGPLARGNSRFAWMTRKSEE  471
S2    395 KIEREDFLRKQRTFDNGSIPHQIHLQEMHAILRRQGDYYPFLKEKQDRIEKILTFRIPYYVGPLVRKDSRFAWAEYRSDE  474
S3    392 KIEREDFLRKQRTFDNGSIPHQIHLQEMNAILRRQGEYYPFLKDNKEKIEKILTFRIPYYVGPLARGNRDFAWLTRNSDE  471
S4    166 --EVRGSINRFKTSD--------YVKEAKQLLKVQKAYHQLDQSFIDTYIDLLETRRTYYEGP--GEGSPFGW------K  227

S1    472 TITPWNFEEVVDKGASAQSFIERMTNFDKNLPNEKVLPKHSLLYEYFTVYNELTKVKYVTEGMRKPAFLSGEQKKAIVDL  551
S2    475 KITPWNFDKVIDKEKSAEKFITRMTLNDLYLPEEKVLPKHSHVYETYAVYNELTKIKYVNEQGKE-SFFDSNMKQEIFDH  553
S3    472 AIRPWNFEEIVDKASSAEDFINKMTNYDLYLPEEKVLPKHSLLYETFAVYNELTKVKFIAEGLRDYQFLDSGQKKQIVNQ  551
S4    228 DIKEW---------------YEMLMGHCTYFPEELRSVKYAYNADLYNALNDLNNLVITRDENEK---LEYYEKFQIIEN  289

S1    552 LEKTNRKVTVKQLKEDYFKKIECFDSVEISGVEDR---FNASLGTYHDLLKIIKDKDFLDNEENEDILEDIVLTLTLFED  628
S2    554 VFKENRKVTKEKLLNYLNKEFPEYRIKDLIGLDKENKSFNASLGTYHDLKKIL-DKAFLDDKVNEEVIEDIIKTLTLFED  632
S3    552 LEKENRKVTEKDIIHYLHN-VDGYDGIELKGIEKQ---FNASLSTYHDLLKIIKDKEEMDDAKNEAILENIVHTLTIFED  627
S4    290 VFKQKKKPTLKQIAKEILVNEEDIKGYRVTSTGKPEF---TNLKVYHDIKDITARKEII---ENAELLDQIAKILTIYQS  363

S1    629 REMIEERLKTYAHLFDDKVMKQLKR-RRYTGWGRLSRKLINGIRDKQSGKTILDFLKSDGFANRNFMQLIHDDSLTFKED  707
S2    633 KDMIHERLQKYSDIFTANQLKKLER-RHYTGWGRLSYKLINGIRNKENNKTILDYLIDDGSANRNFMQLINDDTLPFKQI  711
S3    628 REMIKQRLAQYDSLFDEKVIKALTR-RHYTGWGKLSAKLINGICDKQTGNTILDYLIDDGKINRNFMQLINDDGLSFKEI  706
S4    364 SEDIQEELTNLNSELTQEEIEQISNLKGYTGTHNLSLKAINLILDE------LWHTNDNQIAIFNRLKLVP---------  428

S1    708 IQKAQVSGQG DSLHEHIANLAGSPAIKKGILQTVKVVDELVKVMGRHKPENIVIEMA RENQTT------QKGQKNSRERM  781
S2    712 IQKSQVVGDV DDIEAVVHDLPGSPAIKKGILQSVKIVDELVKVMG-GNPDNIVIEMA RENQTT------NRGRSQSQQRL  784
S3    707 IQKAQVIGKT DDVKQVVQELSGSPAIKKGILQSIKIVDELVKVMG-HAPESIVIEMA RENQTT------ARGKKNSQQRY  779
S4    429 -KKVDLSQQK EIPTTLVDDFILSPVVKRSFIQSIKVINAIIKKYG--LPNDIIIELA REKNSKDAQKMINEMQKRNRQTN  505

S1    782 KRIEEGIKELGSQIL-------KEHPVENTQLQNEKLYLYLQNGRDMYVDQELDINRLSD----YDVDH*IVPQSFLKDD  850
S2    785 KKLQNSLKELGSNILNEEKPSYIEDKVENSHLQNDQLFLYYIQNGKDMYTGDELDIDHLSD----YDIDH*IIPQAFIKDD  860
S3    780 KRIEDSLKILASGL---DSNILKENPTDNNQLQNDRLFYYLQNGKDMYTGEALDINQLSS----YDIDH*IIPQAFIKDD  852
S4    506 ERIEEIIRTTGK--------------ENAKYLIEKIKLHDMQEGKCLYSLEAIPLEDLLNNPFNYEVDH*IIPRSVSFDN  570

S1    851 SIDNKVLTRSDKNRGKSDNVPSEEVVKKMKNYWRQLLNAKLITQRKFDN-LTKAERG GL-SELD------KAGFIKRQLV  922

S2    861 SIDNRVLTSSAKNRGKSDDVPSLDIVRARKAEWVRLYKSGLISKRKFDN-LTKAERG GL-TEAD------KAGFIKRQLV  932

S3    853 SLDNRVLTSSKDNRGKSDNVPSIEVVQKRKAFWQQLLDSKLISERKFNN-LTKAERG GL-DERD------KVGFIKRQLV  924

S4    571 SFNNKVLVKQEEASKKGNRTPFQYLSSSDSKISYETFKKEILNLAKGKGRISKTKKE YLLEERDINRFSVQKDFINRNLV  650

S1    923 ETRQITKHVAQILDSRMNTKYDENDKLIREVKVITLKSKLVSDFRKDFQFYKVREINNYHHAHDAYLNAVVGTALIKKYP 1002
S2    933 ETRQITKHVAQILDARFNTEHDENDKVIRDVKVITLKSNLVSQFRKDFEFYKVREINDYHHAHDAYLNAVVGTALLKKYP 1012
S3    925 ETRQITKHVAQILDARYNTEVNEKDKKNRTVKIITLKSNLVSNFRKEFRLYKVREINDYHHAHDAYLNAVVAKAILKKYP 1004
S4    651 DTRYATRGLMNLLRSYFRVN-------NLDVKVKSINGGFTSFLRRKWKFKKERNKGYKHHAEDALIIA-----------  712

S1   1003 KLESEFVYGDYKVYDVRKMIAKSEQ--EIGKATAKYFFYSNIMNFFKTEITLANGEIRKRPLIETNGETGEIVWDKG---  1077
S2   1013 KLASEFVYGEYKKYDIRKFITNSSD-----KATAKYFFYSNLMNFEKTKVKYADGTVFERPIIETNAD-GEIAWNKQ---  1083
S3   1005 KLEPEFVYGEYQKYDLKRYISRSKDPKEVEKATEKYFFYSNLLNFEKEEVHYADGTIVKRENIEYSKDTGEIAWNKE---  1081
S4    713 --NADFIFKEWKKLDKAKKVMENQM---------------------FEEKQAESMPEIETEQEYKEIFITPHQIK      764

S1   1078 -----RDFATVRKVLSMPQVNIVKKTEVQT GGFSKESILPKRNSDKLIARKKD---WDPKKYGGFDSPTVAYSVLVVAKV 1149
S2   1084 -----IDFEKVRKVLSYPQVNIVKKVETQT GGFSKESILPKGDSDKLIPRKTKKVYWDTKKYGGFDSPTVAYSVFVVADV 1158
S3   1082 -----KDFAIIKKVLSLPQVNIVKKREVQT GGFSKESILPKGNSDKLIPRKTKDILLDTTKYGGFDSPVIAYSILLIADI 1156
S4    765 HIKDFKDYKYSHRVDKKPNRELINDTLYST RKDDKGNTLIVNNLNGLYDKDNDKL----KKLIN-KSP----EKLLMYHH  835

S1   1150 EKGKSKKLKSVKELLGITIMERSSFEKNPI-DFLEAKG-----YKEVKKDLIIKLPKYSLFELENGRKRMLASAGELQKG 1223
S2   1159 EKGKAKKLKTVKELVGISIMERSFFEENPV-EFLENKG-----YHNIREDKLIKLPKYSLFEFEGGRRRLLASASELQKG 1232
S3   1157 EKGKAKKLKTVKTLVGITIMEKAAFEENPI-TFLENKG-----YHNVRKENILCLPKYSLFELENGRRRLLASAKELQKG 1230
S4    836 DPQTYQKLK--------LIMEQYGDEKNPLYKYYEETGNYLTKYSKKDNGPVIKKIKYYGNKLNAHLDITDDYPNSRNKV  907
```

```
S1   1224  NELALPSKYVNFLYLASHYEKLKGSPEDNEQKQLFVEQHKHYLDEITEQISEFSKRVILADANLDKVLSAYNKH------        1297
S2   1233  NEMVLPGYLVELLYHAHRADNF-----NSTEYLNYVSEHKKEFEKVLSCVEDFANLYVDVEKNLSKIRAVADSM------        1301
S3   1231  NEIVLPVYLTTLLYHSKNVHKL-----DEPGHLEYIQKHRNEFKDLLNLVSEFSQKYVLADANLEKIKSLYADN------        1299
S4    908  VKLSLKPYRFD-VYLDNGVYKFV-----TVKNLDVIK--KENYYEVNSKAYEEAKKLKKISNQAEFIASFYNNDLIKING         979

S1   1298  RDKPIREQAENITHLFTLTNLGAPAAFKYFDTTIDRKRYTSTKEVLDATLIHQSIT--------GLYETRI----DLSQL        1365
S2   1302  DNFSIEEISNSFINLLTLTALGAPADFNFLGEKIPRKRYTSTKECLNATLIHQSIT--------GLYETRI----DLSKL        1369
S3   1300  EQADIEILANSFINLLTFTALGAPAAFKFFGKDIDRKRYTTVSEILNATLIHQSIT--------GLYETWI----DLSKL        1367
S4    980  ELYRVIGVNNDLLNRIEVNMIDITYR-EYLENMNDKRPPRIIKTIASKT---QSIKKYSTDILGNLYEVKSKKHPQIIKK       1055

S1   1366  GGD                                                                                   1368
S2   1370  GEE                                                                                   1372
S3   1368  GED                                                                                   1370
S4   1056  G--                                                                                   1056
```

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NOs: 11-14 (e.g., S1, S2, S3, and S4, respectively) are mutated as described herein. The residues D10 and H840 in Cas9 of SEQ ID NO: 1 that correspond to the residues identified in SEQ ID NOs: 11-14 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences that correspond to mutations identified in SEQ ID NO: 1 herein, e.g., mutations of residues 10, and 840 in SEQ ID NO: 1, are referred to herein as "homologous" or "corresponding" mutations. For example, the mutations corresponding to the D10A mutation in SEQ ID NO: 1 or S1 (SEQ ID NO: 11) for the four aligned sequences above are D11A for S2, D10A for S3, and D13A for S4; the corresponding mutations for H840A in SEQ ID NO: 1 or S1 (SEQ ID NO: 11) are H850A for S2, H842A for S3, and H560A for S4.

A total of 250 Cas9 sequences (SEQ ID NOs: 11-260) from different species are provided. Amino acid residues homologous to residues 10, and 840 of SEQ ID NO: 1 may be identified in the same manner as outlined above. All of these Cas9 sequences may be used in accordance with the present disclosure.

| Accession | Description |
|---|---|
| WP_010922251.1 | type II CRISPR RNA-guided endonuclease Cas9 [Streptococcus pyogenes] SEQ ID NO: 11 |
| WP_039695303.1 | type II CRISPR RNA-guided endonuclease Cas9 [Streptococcus gallolyticus] SEQ ID NO: 12 |
| WP_045635197.1 | type II CRISPR RNA-guided endonuclease Cas9 [Streptococcus mitis] SEQ ID NO: 13 |
| 5AXW_A | Cas9, Chain A, Crystal Structure [Staphylococcus Aureus] SEQ ID NO: 14 |
| WP_009880683.1 | type II CRISPR RNA-guided endonuclease Cas9 [Streptococcus pyogenes] SEQ ID NO: 15 |
| WP_010922251.1 | type II CRISPR RNA-guided endonuclease Cas9 [Streptococcus pyogenes] SEQ ID NO: 16 |
| WP_011054416.1 | type II CRISPR RNA-guided endonuclease Cas9 [Streptococcus pyogenes] SEQ ID NO: 17 |
| WP_011284745.1 | type II CRISPR RNA-guided endonuclease Cas9 [Streptococcus pyogenes] SEQ ID NO: 18 |
| WP_011285506.1 | type II CRISPR RNA-guided endonuclease Cas9 [Streptococcus pyogenes] SEQ ID NO: 19 |
| WP_011527619.1 | type II CRISPR RNA-guided endonuclease Cas9 [Streptococcus pyogenes] SEQ ID NO: 20 |
| WP_012560673.1 | type II CRISPR RNA-guided endonuclease Cas9 [Streptococcus pyogenes] SEQ ID NO: 21 |
| WP_014407541.1 | type II CRISPR RNA-guided endonuclease Cas9 [Streptococcus pyogenes] SEQ ID NO: 22 |
| WP_020905136.1 | type II CRISPR RNA-guided endonuclease Cas9 [Streptococcus pyogenes] SEQ ID NO: 23 |
| WP_023080005.1 | type II CRISPR RNA-guided endonuclease Cas9 [Streptococcus pyogenes] SEQ ID NO: 24 |
| WP_023610282.1 | type II CRISPR RNA-guided endonuclease Cas9 [Streptococcus pyogenes] SEQ ID NO: 25 |
| WP_030125963.1 | type II CRISPR RNA-guided endonuclease Cas9 [Streptococcus pyogenes] SEQ ID NO: 26 |
| WP_030126706.1 | type II CRISPR RNA-guided endonuclease Cas9 [Streptococcus pyogenes] SEQ ID NO: 27 |
| WP_031488318.1 | type II CRISPR RNA-guided endonuclease Cas9 [Streptococcus pyogenes] SEQ ID NO: 28 |
| WP_032460140.1 | type II CRISPR RNA-guided endonuclease Cas9 [Streptococcus pyogenes] SEQ ID NO: 29 |
| WP_032461047.1 | type II CRISPR RNA-guided endonuclease Cas9 [Streptococcus pyogenes] SEQ ID NO: 30 |
| WP_032462016.1 | type II CRISPR RNA-guided endonuclease Cas9 [Streptococcus pyogenes] SEQ ID NO: 31 |
| WP_032462936.1 | type II CRISPR RNA-guided endonuclease Cas9 [Streptococcus pyogenes] SEQ ID NO: 32 |
| WP_032464890.1 | type II CRISPR RNA-guided endonuclease Cas9 [Streptococcus pyogenes] SEQ ID NO: 33 |
| WP_033888930.1 | type II CRISPR RNA-guided endonuclease Cas9 [Streptococcus pyogenes] SEQ ID NO: 34 |
| WP_038431314.1 | type II CRISPR RNA-guided endonuclease Cas9 [Streptococcus pyogenes] SEQ ID NO: 35 |
| WP_038432938.1 | type II CRISPR RNA-guided endonuclease Cas9 [Streptococcus pyogenes] SEQ ID NO: 36 |
| WP_038434062.1 | type II CRISPR RNA-guided endonuclease Cas9 [Streptococcus pyogenes] SEQ ID NO: 37 |
| BAQ51233.1 | CRISPR-associated protein, Csn1 family [Streptococcus pyogenes] SEQ ID NO: 38 |
| KGE60162.1 | hypothetical protein MGAS2111_0903 [Streptococcus pyogenes MGAS2111] SEQ ID NO: 39 |
| KGE60856.1 | CRISPR-associated endonuclease protein [Streptococcus pyogenes SS1447] SEQ ID NO: 40 |
| WP_002989955.1 | MULTISPECIES: type II CRISPR RNA-guided endonuclease Cas9 [Streptococcus] SEQ ID NO: 41 |
| WP_003030002.1 | MULTISPECIES: type II CRISPR RNA-guided endonuclease Cas9 [Streptococcus] SEQ ID NO: 42 |
| WP_003065552.1 | MULTISPECIES: type II CRISPR RNA-guided endonuclease Cas9 [Streptococcus] SEQ ID NO: 43 |
| WP_001040076.1 | type II CRISPR RNA-guided endonuclease Cas9 [Streptococcus agalactiae] SEQ ID NO: 44 |
| WP_001040078.1 | type II CRISPR RNA-guided endonuclease Cas9 [Streptococcus agalactiae] SEQ ID NO: 45 |
| WP_001040080.1 | type II CRISPR RNA-guided endonuclease Cas9 [Streptococcus agalactiae] SEQ ID NO: 46 |
| WP_001040081.1 | type II CRISPR RNA-guided endonuclease Cas9 [Streptococcus agalactiae] SEQ ID NO: 47 |
| WP_001040083.1 | type II CRISPR RNA-guided endonuclease Cas9 [Streptococcus agalactiae] SEQ ID NO: 48 |
| WP_001040085.1 | type II CRISPR RNA-guided endonuclease Cas9 [Streptococcus agalactiae] SEQ ID NO: 49 |
| WP_001040087.1 | type II CRISPR RNA-guided endonuclease Cas9 [Streptococcus agalactiae] SEQ ID NO: 50 |
| WP_001040088.1 | type II CRISPR RNA-guided endonuclease Cas9 [Streptococcus agalactiae] SEQ ID NO: 51 |
| WP_001040089.1 | type II CRISPR RNA-guided endonuclease Cas9 [Streptococcus agalactiae] SEQ ID NO: 52 |
| WP_001040090.1 | type II CRISPR RNA-guided endonuclease Cas9 [Streptococcus agalactiae] SEQ ID NO: 53 |

| | |
|---|---|
| WP_001040091.1 | type II CRISPR RNA-guided endonuclease Cas9 [Streptococcus agalactiae] SEQ ID NO: 54 |
| WP_001040092.1 | type II CRISPR RNA-guided endonuclease Cas9 [Streptococcus agalactiae] SEQ ID NO: 55 |
| WP_001040094.1 | type II CRISPR RNA-guided endonuclease Cas9 [Streptococcus agalactiae] SEQ ID NO: 56 |
| WP_001040095.1 | type II CRISPR RNA-guided endonuclease Cas9 [Streptococcus agalactiae] SEQ ID NO: 57 |
| WP_001040096.1 | type II CRISPR RNA-guided endonuclease Cas9 [Streptococcus agalactiae] SEQ ID NO: 58 |
| WP_001040097.1 | type II CRISPR RNA-guided endonuclease Cas9 [Streptococcus agalactiae] SEQ ID NO: 59 |
| WP_001040098.1 | type II CRISPR RNA-guided endonuclease Cas9 [Streptococcus agalactiae] SEQ ID NO: 60 |
| WP_001040099.1 | type II CRISPR RNA-guided endonuclease Cas9 [Streptococcus agalactiae] SEQ ID NO: 61 |
| WP_001040100.1 | type II CRISPR RNA-guided endonuclease Cas9 [Streptococcus agalactiae] SEQ ID NO: 62 |
| WP_001040104.1 | type II CRISPR RNA-guided endonuclease Cas9 [Streptococcus agalactiae] SEQ ID NO: 63 |
| WP_001040105.1 | type II CRISPR RNA-guided endonuclease Cas9 [Streptococcus agalactiae] SEQ ID NO: 64 |
| WP_001040106.1 | type II CRISPR RNA-guided endonuclease Cas9 [Streptococcus agalactiae] SEQ ID NO: 65 |
| WP_001040107.1 | type II CRISPR RNA-guided endonuclease Cas9 [Streptococcus agalactiae] SEQ ID NO: 66 |
| WP_001040108.1 | type II CRISPR RNA-guided endonuclease Cas9 [Streptococcus agalactiae] SEQ ID NO: 67 |
| WP_001040109.1 | type II CRISPR RNA-guided endonuclease Cas9 [Streptococcus agalactiae] SEQ ID NO: 68 |
| WP_001040110.1 | type II CRISPR RNA-guided endonuclease Cas9 [Streptococcus agalactiae] SEQ ID NO: 69 |
| WP_015058523.1 | type II CRISPR RNA-guided endonuclease Cas9 [Streptococcus agalactiae] SEQ ID NO: 70 |
| WP_017643650.1 | type II CRISPR RNA-guided endonuclease Cas9 [Streptococcus agalactiae] SEQ ID NO: 71 |
| WP_017647151.1 | type II CRISPR RNA-guided endonuclease Cas9 [Streptococcus agalactiae] SEQ ID NO: 72 |
| WP_017648376.1 | type II CRISPR RNA-guided endonuclease Cas9 [Streptococcus agalactiae] SEQ ID NO: 73 |
| WP_017649527.1 | type II CRISPR RNA-guided endonuclease Cas9 [Streptococcus agalactiae] SEQ ID NO: 74 |
| WP_017771611.1 | type II CRISPR RNA-guided endonuclease Cas9 [Streptococcus agalactiae] SEQ ID NO: 75 |
| WP_017771984.1 | type II CRISPR RNA-guided endonuclease Cas9 [Streptococcus agalactiae] SEQ ID NO: 76 |
| CFQ25032.1 | CRISPR-associated protein [Streptococcus agalactiae] SEQ ID NO: 77 |
| CFV16040.1 | CRISPR-associated protein [Streptococcus agalactiae] SEQ ID NO: 78 |
| KLJ37842.1 | CRISPR-associated protein Csn1 [Streptococcus agalactiae] SEQ ID NO: 79 |
| KLJ72361.1 | CRISPR-associated protein Csn1 [Streptococcus agalactiae] SEQ ID NO: 80 |
| KLL20707.1 | CRISPR-associated protein Csn1 [Streptococcus agalactiae] SEQ ID NO: 81 |
| KLL42645.1 | CRISPR-associated protein Csn1 [Streptococcus agalactiae] SEQ ID NO: 82 |
| WP_047207273.1 | type II CRISPR RNA-guided endonuclease Cas9 [Streptococcus agalactiae] SEQ ID NO: 83 |
| WP_047209694.1 | type II CRISPR RNA-guided endonuclease Cas9 [Streptococcus agalactiae] SEQ ID NO: 84 |
| WP_050198062.1 | type II CRISPR RNA-guided endonuclease Cas9 [Streptococcus agalactiae] SEQ ID NO: 85 |
| WP_050201642.1 | type II CRISPR RNA-guided endonuclease Cas9 [Streptococcus agalactiae] SEQ ID NO: 86 |
| WP_050204027.1 | type II CRISPR RNA-guided endonuclease Cas9 [Streptococcus agalactiae] SEQ ID NO: 87 |
| WP_050881965.1 | type II CRISPR RNA-guided endonuclease Cas9 [Streptococcus agalactiae] SEQ ID NO: 88 |
| WP_050886065.1 | type II CRISPR RNA-guided endonuclease Cas9 [Streptococcus agalactiae] SEQ ID NO: 89 |
| AHN30376.1 | CRISPR-associated protein Csn1 [Streptococcus agalactiae 138P] SEQ ID NO: 90 |
| EAO78426.1 | reticulocyte binding protein [Streptococcus agalactiae H36B] SEQ ID NO: 91 |
| CCW42055.1 | CRISPR-associated protein, SAG0894 family [Streptococcus agalactiae ILRI112] SEQ ID NO: 92 |
| WP_003041502.1 | type II CRISPR RNA-guided endonuclease Cas9 [Streptococcus anginosus] SEQ ID NO: 93 |
| WP_037593752.1 | type II CRISPR RNA-guided endonuclease Cas9 [Streptococcus anginosus] SEQ ID NO: 94 |
| WP_049516684.1 | CRISPR-associated protein Csn1 [Streptococcus anginosus] SEQ ID NO: 95 |
| GAD46167.1 | hypothetical protein ANG6_0662 [Streptococcus anginosus T5] SEQ ID NO: 96 |
| WP_018363470.1 | type II CRISPR RNA-guided endonuclease Cas9 [Streptococcus caballi] SEQ ID NO: 97 |
| WP_003043819.1 | type II CRISPR RNA-guided endonuclease Cas9 [Streptococcus canis] SEQ ID NO: 98 |
| WP_006269658.1 | type II CRISPR RNA-guided endonuclease Cas9 [Streptococcus constellatus] SEQ ID NO: 99 |
| WP_048800889.1 | type II CRISPR RNA-guided endonuclease Cas9 [Streptococcus constellatus] SEQ ID NO: 100 |
| WP_012767106.1 | type II CRISPR RNA-guided endonuclease Cas9 [Streptococcus dysgalactiae] SEQ ID NO: 101 |
| WP_014612333.1 | type II CRISPR RNA-guided endonuclease Cas9 [Streptococcus dysgalactiae] SEQ ID NO: 102 |
| WP_015017095.1 | type II CRISPR RNA-guided endonuclease Cas9 [Streptococcus dysgalactiae] SEQ ID NO: 103 |
| WP_015057649.1 | type II CRISPR RNA-guided endonuclease Cas9 [Streptococcus dysgalactiae] SEQ ID NO: 104 |
| WP_048327215.1 | type II CRISPR RNA-guided endonuclease Cas9 [Streptococcus dysgalactiae] SEQ ID NO: 105 |
| WP_049519324.1 | CRISPR-associated protein Csn1 [Streptococcus dysgalactiae] SEQ ID NO: 106 |
| WP_012515931.1 | type II CRISPR RNA-guided endonuclease Cas9 [Streptococcus equi] SEQ ID NO: 107 |
| WP_021320964.1 | type II CRISPR RNA-guided endonuclease Cas9 [Streptococcus equi] SEQ ID NO: 108 |
| WP_037581760.1 | type II CRISPR RNA-guided endonuclease Cas9 [Streptococcus equi] SEQ ID NO: 109 |
| WP_004232481.1 | type II CRISPR RNA-guided endonuclease Cas9 [Streptococcus equinus] SEQ ID NO: 110 |
| WP_009854540.1 | type II CRISPR RNA-guided endonuclease Cas9 [Streptococcus gallolyticus] SEQ ID NO: 111 |
| WP_012962174.1 | type II CRISPR RNA-guided endonuclease Cas9 [Streptococcus gallolyticus] SEQ ID NO: 112 |
| WP_039695303.1 | type II CRISPR RNA-guided endonuclease Cas9 [Streptococcus gallolyticus] SEQ ID NO: 113 |
| WP_014334983.1 | type II CRISPR RNA-guided endonuclease Cas9 [Streptococcus infantarius] SEQ ID NO: 114 |
| WP_003099269.1 | type II CRISPR RNA-guided endonuclease Cas9 [Streptococcus iniae] SEQ ID NO: 115 |
| AHY15608.1 | CRISPR-associated protein Csn1 [Streptococcus iniae] SEQ ID NO: 116 |
| AHY17476.1 | CRISPR-associated protein Csn1 [Streptococcus iniae] SEQ ID NO: 117 |
| ESR09100.1 | hypothetical protein IUSA1_08595 [Streptococcus iniae IUSA1] SEQ ID NO: 118 |
| AGM98575.1 | CRISPR-associated protein Cas9/Csn1, subtype II/NMEMI [Streptococcus iniae SF1] SEQ ID NO: 119 |
| ALF27331.1 | CRISPR-associated protein Csn1 [Streptococcus intermedius] SEQ ID NO: 120 |
| WP_018372492.1 | type II CRISPR RNA-guided endonuclease Cas9 [Streptococcus massiliensis] SEQ ID NO: 121 |
| WP_045618028.1 | type II CRISPR RNA-guided endonuclease Cas9 [Streptococcus mitis] SEQ ID NO: 122 |
| WP_045635197.1 | type II CRISPR RNA-guided endonuclease Cas9 [Streptococcus mitis] SEQ ID NO: 123 |
| WP_002263549.1 | type II CRISPR RNA-guided endonuclease Cas9 [Streptococcus mutans] SEQ ID NO: 124 |
| WP_002263887.1 | type II CRISPR RNA-guided endonuclease Cas9 [Streptococcus mutans] SEQ ID NO: 125 |
| WP_002264920.1 | type II CRISPR RNA-guided endonuclease Cas9 [Streptococcus mutans] SEQ ID NO: 126 |
| WP_002269043.1 | type II CRISPR RNA-guided endonuclease Cas9 [Streptococcus mutans] SEQ ID NO: 127 |
| WP_002269448.1 | type II CRISPR RNA-guided endonuclease Cas9 [Streptococcus mutans] SEQ ID NO: 128 |
| WP_002271977.1 | type II CRISPR RNA-guided endonuclease Cas9 [Streptococcus mutans] SEQ ID NO: 129 |
| WP_002272766.1 | type II CRISPR RNA-guided endonuclease Cas9 [Streptococcus mutans] SEQ ID NO: 130 |
| WP_002273241.1 | type II CRISPR RNA-guided endonuclease Cas9 [Streptococcus mutans] SEQ ID NO: 131 |
| WP_002275430.1 | type II CRISPR RNA-guided endonuclease Cas9 [Streptococcus mutans] SEQ ID NO: 132 |

| | | |
|---|---|---|
| WP_002276448.1 | type II CRISPR RNA-guided endonuclease Cas9 [Streptococcus mutans] | SEQ ID NO: 133 |
| WP_002277050.1 | type II CRISPR RNA-guided endonuclease Cas9 [Streptococcus mutans] | SEQ ID NO: 134 |
| WP_002277364.1 | type II CRISPR RNA-guided endonuclease Cas9 [Streptococcus mutans] | SEQ ID NO: 135 |
| WP_002279025.1 | type II CRISPR RNA-guided endonuclease Cas9 [Streptococcus mutans] | SEQ ID NO: 136 |
| WP_002279859.1 | type II CRISPR RNA-guided endonuclease Cas9 [Streptococcus mutans] | SEQ ID NO: 137 |
| WP_002280230.1 | type II CRISPR RNA-guided endonuclease Cas9 [Streptococcus mutans] | SEQ ID NO: 138 |
| WP_002281696.1 | type II CRISPR RNA-guided endonuclease Cas9 [Streptococcus mutans] | SEQ ID NO: 139 |
| WP_002282247.1 | type II CRISPR RNA-guided endonuclease Cas9 [Streptococcus mutans] | SEQ ID NO: 140 |
| WP_002282906.1 | type II CRISPR RNA-guided endonuclease Cas9 [Streptococcus mutans] | SEQ ID NO: 141 |
| WP_002283846.1 | type II CRISPR RNA-guided endonuclease Cas9 [Streptococcus mutans] | SEQ ID NO: 142 |
| WP_002287255.1 | type II CRISPR RNA-guided endonuclease Cas9 [Streptococcus mutans] | SEQ ID NO: 143 |
| WP_002288990.1 | type II CRISPR RNA-guided endonuclease Cas9 [Streptococcus mutans] | SEQ ID NO: 144 |
| WP_002289641.1 | type II CRISPR RNA-guided endonuclease Cas9 [Streptococcus mutans] | SEQ ID NO: 145 |
| WP_002290427.1 | type II CRISPR RNA-guided endonuclease Cas9 [Streptococcus mutans] | SEQ ID NO: 146 |
| WP_002295753.1 | type II CRISPR RNA-guided endonuclease Cas9 [Streptococcus mutans] | SEQ ID NO: 147 |
| WP_002296423.1 | type II CRISPR RNA-guided endonuclease Cas9 [Streptococcus mutans] | SEQ ID NO: 148 |
| WP_002304487.1 | type II CRISPR RNA-guided endonuclease Cas9 [Streptococcus mutans] | SEQ ID NO: 149 |
| WP_002305844.1 | type II CRISPR RNA-guided endonuclease Cas9 [Streptococcus mutans] | SEQ ID NO: 150 |
| WP_002307203.1 | type II CRISPR RNA-guided endonuclease Cas9 [Streptococcus mutans] | SEQ ID NO: 151 |
| WP_002310390.1 | type II CRISPR RNA-guided endonuclease Cas9 [Streptococcus mutans] | SEQ ID NO: 152 |
| WP_002352408.1 | type II CRISPR RNA-guided endonuclease Cas9 [Streptococcus mutans] | SEQ ID NO: 153 |
| WP_012997688.1 | type II CRISPR RNA-guided endonuclease Cas9 [Streptococcus mutans] | SEQ ID NO: 154 |
| WP_014677909.1 | type II CRISPR RNA-guided endonuclease Cas9 [Streptococcus mutans] | SEQ ID NO: 155 |
| WP_019312892.1 | type II CRISPR RNA-guided endonuclease Cas9 [Streptococcus mutans] | SEQ ID NO: 156 |
| WP_019313659.1 | type II CRISPR RNA-guided endonuclease Cas9 [Streptococcus mutans] | SEQ ID NO: 157 |
| WP_019314093.1 | type II CRISPR RNA-guided endonuclease Cas9 [Streptococcus mutans] | SEQ ID NO: 158 |
| WP_019315370.1 | type II CRISPR RNA-guided endonuclease Cas9 [Streptococcus mutans] | SEQ ID NO: 159 |
| WP_019803776.1 | type II CRISPR RNA-guided endonuclease Cas9 [Streptococcus mutans] | SEQ ID NO: 160 |
| WP_019805234.1 | type II CRISPR RNA-guided endonuclease Cas9 [Streptococcus mutans] | SEQ ID NO: 161 |
| WP_024783594.1 | type II CRISPR RNA-guided endonuclease Cas9 [Streptococcus mutans] | SEQ ID NO: 162 |
| WP_024784288.1 | type II CRISPR RNA-guided endonuclease Cas9 [Streptococcus mutans] | SEQ ID NO: 163 |
| WP_024784666.1 | type II CRISPR RNA-guided endonuclease Cas9 [Streptococcus mutans] | SEQ ID NO: 164 |
| WP_024784894.1 | type II CRISPR RNA-guided endonuclease Cas9 [Streptococcus mutans] | SEQ ID NO: 165 |
| WP_024786433.1 | type II CRISPR RNA-guided endonuclease Cas9 [Streptococcus mutans] | SEQ ID NO: 166 |
| WP_049473442.1 | CRISPR-associated protein Csn1 [Streptococcus mutans] | SEQ ID NO: 167 |
| WP_049474547.1 | CRISPR-associated protein Csn1 [Streptococcus mutans] | SEQ ID NO: 168 |
| EMC03581.1 | hypothetical protein SMU69_09359 [Streptococcus mutans NLML4] | SEQ ID NO: 169 |
| WP_000428612.1 | type II CRISPR RNA-guided endonuclease Cas9 [Streptococcus oralis] | SEQ ID NO: 170 |
| WP_000428613.1 | type II CRISPR RNA-guided endonuclease Cas9 [Streptococcus oralis] | SEQ ID NO: 171 |
| WP_049523028.1 | CRISPR-associated protein Csn1 [Streptococcus parasanguinis] | SEQ ID NO: 172 |
| WP_003107102.1 | type II CRISPR RNA-guided endonuclease Cas9 [Streptococcus parauberis] | SEQ ID NO: 173 |
| WP_054279288.1 | type II CRISPR RNA-guided endonuclease Cas9 [Streptococcus phocae] | SEQ ID NO: 174 |
| WP_049531101.1 | CRISPR-associated protein Csn1 [Streptococcus pseudopneumoniae] | SEQ ID NO: 175 |
| WP_049538452.1 | CRISPR-associated protein Csn1 [Streptococcus pseudopneumoniae] | SEQ ID NO: 176 |
| WP_049549711.1 | CRISPR-associated protein Csn1 [Streptococcus pseudopneumoniae] | SEQ ID NO: 177 |
| WP_007896501.1 | type II CRISPR RNA-guided endonuclease Cas9 [Streptococcus pseudoporcinus] | SEQ ID NO: 178 |
| EFR44625.1 | CRISPR-associated protein, Csn1 family [Streptococcus pseudoporcinus SPIN 20026] | SEQ ID NO: 179 |
| WP_002897477.1 | type II CRISPR RNA-guided endonuclease Cas9 [Streptococcus sanguinis] | SEQ ID NO: 180 |
| WP_002906454.1 | type II CRISPR RNA-guided endonuclease Cas9 [Streptococcus sanguinis] | SEQ ID NO: 181 |
| WP_009729476.1 | type II CRISPR RNA-guided endonuclease Cas9 [Streptococcus sp. F0441] | SEQ ID NO: 182 |
| CQR24647.1 | CRISPR-associated protein [Streptococcus sp. FF10] | SEQ ID NO: 183 |
| WP_000066813.1 | type II CRISPR RNA-guided endonuclease Cas9 [Streptococcus sp. M334] | SEQ ID NO: 184 |
| WP_009754323.1 | type II CRISPR RNA-guided endonuclease Cas9 [Streptococcus sp. taxon 056] | SEQ ID NO: 185 |
| WP_044674937.1 | type II CRISPR RNA-guided endonuclease Cas9 [Streptococcus suis] | SEQ ID NO: 186 |
| WP_044676715.1 | type II CRISPR RNA-guided endonuclease Cas9 [Streptococcus suis] | SEQ ID NO: 187 |
| WP_044680361.1 | type II CRISPR RNA-guided endonuclease Cas9 [Streptococcus suis] | SEQ ID NO: 188 |
| WP_044681799.1 | type II CRISPR RNA-guided endonuclease Cas9 [Streptococcus suis] | SEQ ID NO: 189 |
| WP_049533112.1 | CRISPR-associated protein Csn1 [Streptococcus suis] | SEQ ID NO: 190 |
| WP_029090905.1 | type II CRISPR RNA-guided endonuclease Cas9 [Brochothrix thermosphacta] | SEQ ID NO: 191 |
| WP_006506696.1 | type II CRISPR RNA-guided endonuclease Cas9 [Catenibacterium mitsuokai] | SEQ ID NO: 192 |
| AIT42264.1 | Cas9hc:NLS:HA [Cloning vector pYB196] | SEQ ID NO: 193 |
| WP_034440723.1 | type II CRISPR endonuclease Cas9 [Clostridiales bacterium S5-A11] | SEQ ID NO: 194 |
| AKQ21048.1 | Cas9 [CRISPR-mediated gene targeting vector p(bhsp68-Cas9)] | SEQ ID NO: 195 |
| WP_004636532.1 | type II CRISPR RNA-guided endonuclease Cas9 [Dolosigranulum pigrum] | SEQ ID NO: 196 |
| WP_002364836.1 | MULTISPECIES: type II CRISPR RNA-guided endonuclease Cas9 [Enterococcus] | SEQ ID NO: 197 |
| WP_016631044.1 | MULTISPECIES: type II CRISPR RNA-guided endonuclease Cas9 [Enterococcus] | SEQ ID NO: 198 |
| EMS75795.1 | hypothetical protein H318_06676 [Enterococcus durans IPLA 655] | SEQ ID NO: 199 |
| WP_002373311.1 | type II CRISPR RNA-guided endonuclease Cas9 [Enterococcus faecalis] | SEQ ID NO: 200 |
| WP_002378009.1 | type II CRISPR RNA-guided endonuclease Cas9 [Enterococcus faecalis] | SEQ ID NO: 201 |
| WP_002407324.1 | type II CRISPR RNA-guided endonuclease Cas9 [Enterococcus faecalis] | SEQ ID NO: 202 |
| WP_002413717.1 | type II CRISPR RNA-guided endonuclease Cas9 [Enterococcus faecalis] | SEQ ID NO: 203 |
| WP_010775580.1 | type II CRISPR RNA-guided endonuclease Cas9 [Enterococcus faecalis] | SEQ ID NO: 204 |
| WP_010818269.1 | type II CRISPR RNA-guided endonuclease Cas9 [Enterococcus faecalis] | SEQ ID NO: 205 |
| WP_010824395.1 | type II CRISPR RNA-guided endonuclease Cas9 [Enterococcus faecalis] | SEQ ID NO: 206 |
| WP_016622645.1 | type II CRISPR RNA-guided endonuclease Cas9 [Enterococcus faecalis] | SEQ ID NO: 207 |
| WP_033624816.1 | type II CRISPR RNA-guided endonuclease Cas9 [Enterococcus faecalis] | SEQ ID NO: 208 |
| WP_033625576.1 | type II CRISPR RNA-guided endonuclease Cas9 [Enterococcus faecalis] | SEQ ID NO: 209 |
| WP_033789179.1 | type II CRISPR RNA-guided endonuclease Cas9 [Enterococcus faecalis] | SEQ ID NO: 210 |
| WP_002310644.1 | type II CRISPR RNA-guided endonuclease Cas9 [Enterococcus faecium] | SEQ ID NO: 211 |

-continued

| | | |
|---|---|---|
| WP_002312694.1 | type II CRISPR RNA-guided endonuclease Cas9 [Enterococcus faecium] | SEQ ID NO: 212 |
| WP_002314015.1 | type II CRISPR RNA-guided endonuclease Cas9 [Enterococcus faecium] | SEQ ID NO: 213 |
| WP_002320716.1 | type II CRISPR RNA-guided endonuclease Cas9 [Enterococcus faecium] | SEQ ID NO: 214 |
| WP_002330729.1 | type II CRISPR RNA-guided endonuclease Cas9 [Enterococcus faecium] | SEQ ID NO: 215 |
| WP_002335161.1 | type II CRISPR RNA-guided endonuclease Cas9 [Enterococcus faecium] | SEQ ID NO: 216 |
| WP_002345439.1 | type II CRISPR RNA-guided endonuclease Cas9 [Enterococcus faecium] | SEQ ID NO: 217 |
| WP_034867970.1 | type II CRISPR RNA-guided endonuclease Cas9 [Enterococcus faecium] | SEQ ID NO: 218 |
| WP_047937432.1 | type II CRISPR RNA-guided endonuclease Cas9 [Enterococcus faecium] | SEQ ID NO: 219 |
| WP_010720994.1 | type II CRISPR RNA-guided endonuclease Cas9 [Enterococcus hirae] | SEQ ID NO: 220 |
| WP_010737004.1 | type II CRISPR RNA-guided endonuclease Cas9 [Enterococcus hirae] | SEQ ID NO: 221 |
| WP_034700478.1 | type II CRISPR RNA-guided endonuclease Cas9 [Enterococcus hirae] | SEQ ID NO: 222 |
| WP_007209003.1 | type II CRISPR RNA-guided endonuclease Cas9 [Enterococcus italicus] | SEQ ID NO: 223 |
| WP_023519017.1 | type II CRISPR RNA-guided endonuclease Cas9 [Enterococcus mundtii] | SEQ ID NO: 224 |
| WP_010770040.1 | type II CRISPR RNA-guided endonuclease Cas9 [Enterococcus phoeniculicola] | SEQ ID NO: 225 |
| WP_048604708.1 | type II CRISPR RNA-guided endonuclease Cas9 [Enterococcus sp. AM1] | SEQ ID NO: 226 |
| WP_010750235.1 | type II CRISPR RNA-guided endonuclease Cas9 [Enterococcus villorum] | SEQ ID NO: 227 |
| AII16583.1 | Cas9 endonuclease [Expression vector pCas9] | SEQ ID NO: 228 |
| WP_029073316.1 | type II CRISPR RNA-guided endonuclease Cas9 [Kandleria vitulina] | SEQ ID NO: 229 |
| WP_031589969.1 | type II CRISPR RNA-guided endonuclease Cas9 [Kandleria vitulina] | SEQ ID NO: 230 |
| KDA45870.1 | CRISPR-associated protein Cas9/Csn1, subtype II/NMEMI [Lactobacillus animalis] | SEQ ID NO: 231 |
| WP_039099354.1 | type II CRISPR RNA-guided endonuclease Cas9 [Lactobacillus curvatus] | SEQ ID NO: 232 |
| AKP02966.1 | hypothetical protein ABB45_04605 [Lactobacillus farciminis] | SEQ ID NO: 233 |
| WP_010991369.1 | type II CRISPR RNA-guided endonuclease Cas9 [Listeria innocua] | SEQ ID NO: 234 |
| WP_033838504.1 | type II CRISPR RNA-guided endonuclease Cas9 [Listeria innocua] | SEQ ID NO: 235 |
| EHN60060.1 | CRISPR-associated protein, Csn1 family [Listeria innocua ATCC 33091] | SEQ ID NO: 236 |
| EFR89594.1 | crispr-associated protein, Csn1 family [Listeria innocua FSL S4-378] | SEQ ID NO: 237 |
| WP_038409211.1 | type II CRISPR RNA-guided endonuclease Cas9 [Listeria ivanovii] | SEQ ID NO: 238 |
| EFR95520.1 | crispr-associated protein Csn1 [Listeria ivanovii FSL F6-596] | SEQ ID NO: 239 |
| WP_003723650.1 | type II CRISPR RNA-guided endonuclease Cas9 [Listeria monocytogenes] | SEQ ID NO: 240 |
| WP_003727705.1 | type II CRISPR RNA-guided endonuclease Cas9 [Listeria monocytogenes] | SEQ ID NO: 241 |
| WP_003730785.1 | type II CRISPR RNA-guided endonuclease Cas9 [Listeria monocytogenes] | SEQ ID NO: 242 |
| WP_003733029.1 | type II CRISPR RNA-guided endonuclease Cas9 [Listeria monocytogenes] | SEQ ID NO: 243 |
| WP_003739838.1 | type II CRISPR RNA-guided endonuclease Cas9 [Listeria monocytogenes] | SEQ ID NO: 244 |
| WP_014601172.1 | type II CRISPR RNA-guided endonuclease Cas9 [Listeria monocytogenes] | SEQ ID NO: 245 |
| WP_023548323.1 | type II CRISPR RNA-guided endonuclease Cas9 [Listeria monocytogenes] | SEQ ID NO: 246 |
| WP_031665337.1 | type II CRISPR RNA-guided endonuclease Cas9 [Listeria monocytogenes] | SEQ ID NO: 247 |
| WP_031669209.1 | type II CRISPR RNA-guided endonuclease Cas9 [Listeria monocytogenes] | SEQ ID NO: 248 |
| WP_033920898.1 | type II CRISPR RNA-guided endonuclease Cas9 [Listeria monocytogenes] | SEQ ID NO: 249 |
| AKI42028.1 | CRISPR-associated protein [Listeria monocytogenes] | SEQ ID NO: 250 |
| AKI50529.1 | CRISPR-associated protein [Listeria monocytogenes] | SEQ ID NO: 251 |
| EFR83390.1 | crispr-associated protein Csn1 [Listeria monocytogenes FSL F2-208] | SEQ ID NO: 252 |
| WP_046323366.1 | type II CRISPR RNA-guided endonuclease Cas9 [Listeria seeligeri] | SEQ ID NO: 253 |
| AKE81011.1 | Cas9 [Plant multiplex genome editing vector pYLCRISPR/Cas9Pubi-H] | SEQ ID NO: 254 |
| CUO82355.1 | Uncharacterized protein conserved in bacteria [Roseburia hominis] | SEQ ID NO: 255 |
| WP_033162887.1 | type II CRISPR RNA-guided endonuclease Cas9 [Sharpea azabuensis] | SEQ ID NO: 256 |
| AGZ01981.1 | Cas9 endonuclease [synthetic construct] | SEQ ID NO: 257 |
| AKA60242.1 | nuclease deficient Cas9 [synthetic construct] | SEQ ID NO: 258 |
| AKS40380.1 | Cas9 [Synthetic plasmid pFC330] | SEQ ID NO: 259 |
| 4UN5_B | Cas9, Chain B, Crystal Structure | SEQ ID NO: 260 |

Non-limiting examples of suitable deaminase domains are provided.

```
Human AID
                                                        (SEQ ID NO: 303)
MDSLLMNRRKFLYQFKNVRWAKGRRETYLCYVVKRRDSATSFSLDFGYLRNKNGCHVELLFLRYISD

WDLDPGRCYRVTWFTSWSPCYDCARHVADFLRGNPNLSLRIFTARLYFCEDRKAEPEGLRRLHRAGV

QIAIMTFKDYFYCWNTFVENHERTFKAWEGLHENSVRLSRQLRRILLPLYEVDDLRDAFRTLGL (underline: nuclear localization signal; double underline: nuclear export signal)

Mouse AID
                                                        (SEQ ID NO: 271)
MDSLLMKQKKFLYHFKNVRWAKGRHETYLCYVVKRRDSATSCSLDFGHLRNKSGCHVELLFLRYISD

WDLDPGRCYRVTWFTSWSPCYDCARHVAEFLRWNPNLSLRIFTARLYFCEDRKAEPEGLRRLHRAGV

QIGIMTFKDYFYCWNTFVENRERTFKAWEGLHENSVRLTRQLRRILLPLYEVDDLRDAFRMLGF (underline: nuclear localization signal; double underline: nuclear export signal)
```

Dog AID (SEQ ID NO: 272)

<u>MDSLLMKQRKFLYHFKNVRWAKGRHETYLC</u>YVVKRRDSATSFSLDFGHLRNKSGCHVELLFLRYISD
WDLDPGRCYRVTWFTSWSPCYDCARHVADFLRGYPNLSRIFAARLYFCEDRKAEPEGLRRLHRAGV
QIAIMTFKDYFYCWNTFVENREKTFKAWEGLHENSVRLSRQLRRILLP<u>LYEVDDLRDAFRTLGL</u>

(underline: nuclear localization signal; double underline: nuclear export signal)

Bovine AID (SEQ ID NO: 273)

<u>MDSLLKKQRQFLYQFKNVRWAKGRHETYLC</u>YVVKRRDSPTSFSLDFGHLRNKAGCHVELLFLRYISD
WDLDPGRCYRVTWFTSWSPCYDCARHVADFLRGYPNLSRIFTARLYFCDKERKAEPEGLRRLHRAG
VQIAIMTFKDYFYCWNTFVENHERTFKAWEGLHENSVRLSRQLRRILLP<u>LYEVDDLRDAFRTLGL</u>

(underline: nuclear localization signal; double underline: nuclear export signal)

Rat AID (SEQ ID NO: 2483)

MAVGSKPKAALVGPHWERERIWCFLCSTGLGTQQTGQTSRWLRPAATQDPVSPPRSLLMKQRKFLYH
FKNVRWAKGRHETYLCYVVKRRDSATSFSLDFGYLRNKSGCHVELLFLRYISDWDLDPGRCYRVTWF
TSWSPCYDCARHVADFLRGNPNLSRIFTARLTGWGALPAGLMSPARPSDYFYCWNTFVENHERTFKA
WEGLHENSVRLSRRLRRILLPLYEVDDLRDAFRTLGL

Mouse APOBEC-3 (SEQ ID NO: 274)

MGPFCLGCSHRKCYSPIRNLISQETFKFHFKNLGYAKGRKDTFLCYEVTRKDCDSPVSLHHGVFKND
NI*HAEICFLYWFHDKVLKVLSPREEFKITWYMSWSPCFEC*AEQIVRFLATHHNLSLDIFSSRLYNVQDPETQ
QNLCRLVQEGAQVAAMDLYEFKKCWKKFVDNGGRRFRPWKRLLTNFRYQDSKLQEILRPCYIPVPSS
SSSTLSNICLTKGLPETRFCVEGRRMDPLSEEEFYSQFYNQRVKHLCYYHRMKPYLCYQLEQFNGQAPL
KGCLLSEKGKQ*HAEILFLDKIRSMELSQVTITCYLTWSPCPNC*AWQLAAFKRDRPDLILHIYTSRLYFHWK
RPFQKGLCSLWQSGILVDVMDLPQFTDCWTNFVNPKRPFWPWKGLEIISRRTQRRLRRIKESWGLQDL
VNDFGNLQLGPPMS (italic: nucleic acid editing domain)

Rat APOBEC-3 (SEQ ID NO: 275)

MGPFCLGCSHRKCYSPIRNLISQETFKFHFKNLRYAIDRKDTFLCYEVTRKDCDSPVSLHHGVFKNKDN
I*HAEICFLYWFHDKVLKVLSPREEFKITWYMSWSPCFEC*AEQVLRFLATHHNLSLDIFSSRLYNIRDPENQQ
NLCRLVQEGAQVAAMDLYEFKKCWKKFVDNGGRRFRPWKKLLTNFRYQDSKLQEILRPCYIPVPSSSS
STLSNICLTKGLPETRFCVERRRVHLLSEEEFYSQFYNQRVKHLCYYHGVKPYLCYQLEQFNGQAPLKG
CLLSEKGKQ*HAEILFLDKIRSMELSQVIITCYLTWSPCPNC*AWQLAAFKRDRPDLILHIYTSRLYFHWKRPF
QKGLCSLWQSGILVDVMDLPQFTDCWTNFVNPKRPFWPWKGLEIISRRTQRRLHRIKESWGLQDLVND
FGNLQLGPPMS (italic: nucleic acid editing domain)

Rhesus macaque APOBEC-3G (SEQ ID NO: 276)

<u>MVEPMDPRTFVSNFNNRPILSGLNTVWLCCEVKTKDPSGPPLDAKIFQGKVYSKAKY*HPEMRFLRWFH
KWRQLHHDQEYKVTWYVSWSPCTRC*</u>ANSVATFLAKDPKVTLTIFVARLYYFWKPDYQQALRILCQKRG
GPHATMKIMNYNEFQDCWNKFVDGRGKPFKPRNNLPKHYTLLQATLGELLRHLMDPGTFTSNFNNKP

WVSGQHETYLCYKVERLHNDTWVPLNQHRGFLRNQAPNIHGFPKGR*HAELCFLDLIPFWKLDGQQYRV*

*TCFTSWSPCFSC*AQEMAKFISNNEHVSLCIFAARIYDDQGRYQEGLRALHRDGAKIAMMNYSEFEYCW

DTFVDRQGRPFQPWDGLDEHSQALSGRLRAI (italic: nucleic acid editing domain;

underline: cytoplasmic localization signal)

Chimpanzee APOBEC-3G (SEQ ID NO: 277)

<u>MKPHFRNPVERMYQDTFSDNFYNRPILSHRNTVWLCYEVKTKGPSRPPLDAKIFRGQVYSKLKY</u>*HPEM*

*RFFHWFSKWRKLHRDQEYEVTWYISWSPCTKC*TRDVATFLAEDPKVTLTIFVARLYYFWDPDYQEALRS

LCQKRDGPRATMKIMNYDEFQHCWSKFVYSQRELFEPWNNLPKYYILLHIMLGEILRHSMDPPTFTSN

FNNELWVRGRHETYLCYEVERLHNDTWVLLNQRRGFLCNQAPHKHGFLEGR*HAELCFLDVIPFWKLD*

*LHQDYRVTCFTSWSPCFSC*AQEMAKFISNNKHVSLCIFAARIYDDQGRCQEGLRTLAKAGAKISIMTYSE

FKHCWDTFVDHQGCPFQPWDGLEEHSQALSGRLRAILQNQGN (italic: nucleic acid editing domain; underline: cytoplasmic localization signal)

Green monkey APOBEC-3G (SEQ ID NO: 278)

<u>MNPQIRNMVEQMEPDIFVYYFNNRPILSGRNTVWLCYEVKTKDPSGPPLDANIFQGKLYPEAKD</u>*HPEM*

*KFLHWFRKWRQLHRDQEYEVTWYVSWSPCTRC*ANSVATFLAEDPKVTLTIFVARLYYFWKPDYQQALRI

LCQERGGPHATMKIMNYNEFQHCWNEFVDGQKPFKPRKNLPKHYTLLHATLGELLRHVMDPGTFTS

NFNNKPWVSGQRETYLCYKVERSHNDTWVLLNQHRGFLRNQAPDRHGFPKGR*HAELCFLDLIPFWKL*

*DDQQYRVTCFTSWSPCFSC*AQKMAKFISNNKHVSLCIFAARIYDDQGRCQEGLRTLHRDGAKIAVMNYS

EFEYCWDTFVDRQGRPFQPWDGLDEHSQALSGRLRAI (italic: nucleic acid editing domain; underline: cytoplasmic localization signal)

Human APOBEC-3G (SEQ ID NO: 279)

<u>MKPHFRNTVERMYRDTFSYNFYNRPILSRRNTVWLCYEVKTKGPSRPPLDAKIFRGQVYSELKY</u>*HPEM*

*RFFHWFSKWRKLHRDQEYEVTWYISWSPCTKC*TRDMATFLAEDPKVTLTIFVARLYYFWDPDYQEALRS

LCQKRDGPRATMKIMNYDEFQHCWSKFVYSQRELFEPWNNLPKYYILLHIMLGEILRHSMDPPTFTFN

FNNEPWVRGRHETYLCYEVERMHNDTWVLLNQRRGFLCNQAPHKHGFLEGR*HAELCFLDVIPFWKLD*

*LDQDYRVTCFTSWSPCFSC*AQEMAKFISKNKHVSLCIFTARIYDDQGRCQEGLRTLAEAGAKISIMTYSE

FKHCWDTFVDHQGCPFQPWDGLDEHSQDLSGRLRAILQNQEN (italic: nucleic acid editing domain; underline: cytoplasmic localization signal)

Human APOBEC-3F (SEQ ID NO: 280)

MKPHFRNTVERMYRDTFSYNFYNRPILSRRNTVWLCYEVKTKGPSRPRLDAKIFRGQVYSQPEH*HAEM*

*CFLSWFCGNQLPAYKCFQITWFVSWTPCPDC*VAKLAEFLAEHPNVTLTISAARLYYYWERDYRRALCRL

SQAGARVKIMDDEEFAYCWENFVYSEGQPFMPWYKFDDNYAFLHRTLKEILRNPMEAMYPHIFYFHF

KNLRKAYGRNESWLCFTMEVVKHHSPVSWKRGVFRNQVDPETHC*HAERCFLSWFCDDILSPNTNYEVT*

*WYTSWSPCPEC*AGEVAEFLARHSNVNLTIFTARLYYFWDTDYQEGLRSLSQEGASVEIMGYKDFKYCW

ENFVYNDDEPFKPWKGLKYNFLFLDSKLQEILE (italic: nucleic acid editing domain)

Human APOBEC-3B (SEQ ID NO: 281)

MNPQIRNPMERMYRDTFYDNFENEPILYGRSYTWLCYEVKIKRGRSNLLWDTGVFRGQVYFKPQY*HA*

*EMCFLSWFCGNQLPAYKCFQITWFVSWTPCPDC*VAKLAEFLSEHPNVTLTISAARLYYYWERDYRRALC

RLSQAGARVTIMDYEEFAYCWENFVYNEGQQFMPWYKFDENYAFLHRTLKEILRYLMDPDTFTFNFN

NDPLVLRRRQTYLCYEVERLDNGTWVLMDQHMGFLCNEAKNLLCGFY*GRHAELRFLDLVPSLQLDPA*

-continued

QIYRVTWFISWSPCFSWGCAGEVRAFLQENTHVRLRIFAARIYDYDPLYKEALQMLRDAGAQVSIMTYD

EFEYCWDTFVYRQGCPFQPWDGLEEHSQALSGRLRAILQNQGN (italic: nucleic acid editing domain)

Rat APOBEC-3B:
(SEQ ID NO: 2484)
MQPQGLGPNAGMGPVCLGCSHRRPYSPIRNPLKKLYQQTFYFHFKNVRYAWGRKNNFLCYEVNGMD

CALPVPLRQGVFRKQGHIHAELCFIYWFHDKVLRVLSPMEEFKVTWYMSWSPCSKCAEQVARFLAAH

RNLSLAIFSSRLYYYLRNPNYQQKLCRLIQEGVHVAAMDLPEFKKCWNKFVDNDGQPFRPWMRLRINF

SFYDCKLQEIFSRMNLLREDVFYLQFNNSHRVKPVQNRYYRRKSYLCYQLERANGQEPLKGYLLYKK

GEQHVEILFLEKMRSMELSQVRITCYLTWSPCPNCARQLAAFKKDHPDLILRIYTSRLYFYWRKKFQKG

LCTLWRSGIHVDVMDLPQFADCWTNFVNPQRPFRPWNELEKNSWRIQRRLRRIKESWGL

Bovine APOBEC-3B:
(SEQ ID NO: 2485)
DGWEVAFRSGTVLKAGVLGVSMTEGWAGSGHPGQGACVWTPGTRNTMNLLREVLFKQQFGNQPRV

PAPYYRRKTYLCYQLKQRNDLTLDRGCFRNKKQRHAEIRFIDKINSLDLNPSQSYKIICYITWSPCPNCA

NELVNFITRNNHLKLEIFASRLYFHWIKSFKMGLQDLQNAGISVAVMTHTEFEDCWEQFVDNQSRPFQP

WDKLEQYSASIRRRLQRILTAPI

Chimpanzee APOBEC-3B:
(SEQ ID NO: 2486)
MNPQIRNPMEWMYQRTFYYNFENEPILYGRSYTWLCYEVKIRRGHSNLLWDTGVFRGQMYSQPEHH

AEMCFLSWFCGNQLSAYKCFQITWFVSWTPCPDCVAKLAKFLAEHPNVTLTISAARLYYYWERDYRR

ALCRLSQAGARVKIMDDEEFAYCWENFVYNEGQPFMPWYKFDDNYAFLHRTLKEIIRHLMDPDTFTF

NFNNDPLVLRRHQTYLCYEVERLDNGTWVLMDQHMGFLCNEAKNLLCGFYGRHAELRFLDLVPSLQ

LDPAQIYRVTWFISWSPCFSWGCAGQVRAFLQENTHVRLRIFAARIYDYDPLYKEALQMLRDAGAQVS

IMTYDEFEYCWDTFVYRQGCPFQPWDGLEEHSQALSGRLRAILQVRASSLCMVPHRPPPPPQSPGPCLP

LCSEPPLGSLLPTGRPAPSLPFLLTASFSFPPPASLPPLPSLSLSPGHLPVPSFHSLTSCSIQPPCSSRIRETEG

WASVSKEGRDLG

Human APOBEC-3C:
(SEQ ID NO: 282)
MNPQIRNPMKAMYPGTFYFQFKNLWEANDRNETWLCFTVEGIKRRSVVSWKTGVFRNQVDSETH*CH*

*AERCFLSWFCDDILSPNTKYQWWYTSWSPCPDC*AGEVAEFLARHSNVNLTIFTARLYYFQYPCYQEGLR

SLSQEGVAVEIMDYEDFKYCWENFVYNDNEPFKPWKGLKTNFRLLKRRLRESLQ (italic: nucleic acid editing domain)

Gorilla APOBEC3C:
(SEQ ID NO: 2487)
MNPQIRNPMKAMYPGTFYFQFKNLWEANDRNETWLCFTVEGIKRRSVVSWKTGVFRNQVDSETHCH

AERCFLSWFCDDILSPNTNYQVTWYTSWSPCPECAGEVAEFLARHSNVNLTIFTARLYYFQDTDYQEG

LRSLSQEGVAVKIMDYKDFKYCWENFVYNDDEPFKPWKGLKYNFRFLKRRLQEILE

Human APOBEC-3A:
(SEQ ID NO: 283)
MEASPASGPRHLMDPHIFTSNFNNGIGRHKTYLCYEVERLDNGTSVKMDQHRGFLHNQAKNLLCGFY

GR*HAELRFLDLVPSLQLDPAQIYRWWFISWSPCFSWGC*AGEVRAFLQENTHVRLRIFAARIYDYDPLYKE

ALQMLRDAGAQVSIMTYDEFKHCWDTFVDHQGCPFQPWDGLDEHSQALSGRLRAILQNQGN (italic: nucleic acid editing domain)

-continued

Rhesus macaque APOBEC-3A:
(SEQ ID NO: 2488)
MDGSPASRPRHLMDPNTFTFNFNNDLSVRGRHQTYLCYEVERLDNGTWVPMDERRGFLCNKAKNVP

CGDYGCHVELRFLCEVPSWQLDPAQTYRVTWFISWSPCFRRGCAGQVRVFLQENKHVRLRIFAARIYD

YDPLYQEALRTLRDAGAQVSIMTYEEFKHCWDTFVDRQGRPFQPWDGLDEHSQALSGRLRAILQNQG

N

Bovine APOBEC-3A:
(SEQ ID NO: 2489)
MDEYTFTENFNNQGWPSKTYLCYEMERLDGDATIPLDEYKGFVRNKGLDQPEKPCHAELYFLGKIHS

WNLDRNQHYRLTCFISWSPCYDCAQKLTTFLKENHHISLHILASRIYTHNRFGCHQSGLCELQAAGARI

TIMTFEDFKHCWETFVDHKGKPFQPWEGLNVKSQALCTELQAILKTQQN

Human APOBEC-3H:
(SEQ ID NO: 284)
MALLTAETFRLQFNNKRRLRRPYYPRKALLCYQLTPQNGSTPTRGYFENKKK*CHAEICHNEIKSMGLD*

*ETQCYQVTCYLTWSPCSSCAWELVDFIKAHDHLNLGIFASRLYYHWCKPQQKGLRLLCGSQVPVEVMG*

*FPKFADCWENFVDHEKPLSFNPYKMLEELDKNSRAIKRRLERIKIPGVRAQGRYMDILCDAEV*

(italic: nucleic acid editing domain)

Rhesus macaque APOBEC-3H:
(SEQ ID NO: 2490)
MALLTAKTFSLQFNNKRRVNKPYYPRKALLCYQLTPQNGSTPTRGHLKNKKKDHAEIRFINKIKSMGL

DETQCYQVTCYLTWSPCPSCAGELVDFIKAHRHLNLRIFASRLYYHWRPNYQEGLLLLCGSQVPVEVM

GLPEFTDCWENFVDHKEPPSFNPSEKLEELDKNSQAIKRRLERIKSRS VDVLENGLRS QLGPVTPS S SIR

NSR

Human APOBEC-3D
(SEQ ID NO: 285)
MNPQIRNPMERMYRDTFYDNFENEPILYGRSYTWLCYEVKIKRGRSNLLWDTGVFRGPVLPKRQSNH

RQEVYFRFEN*HAEMCFLSWFCGNRLPANRRFQITWFVSWNPCLPCVV*KVTKFLAEHPNVTLTISAARLY

YYRDRDWRWVLLRLHKAGARVKIMDYEDFAYCWENFVCNEGQPFMPWYKFDDNYASLHRTLKEIL

RNPMEAMYPHIFYFHFKNLLKACGRNESWLCFTMEVTKHHSAVFRKRGVFRNQVDPETHC*HAERCFL*

*SWFCDDILSPNTNYEVTWYTSWSPCPEC*AGEVAEFLARHSNVNLTIFTARLCYFWDTDYQEGLCSLSQEG

ASVKIMGYKDFVSCWKNFVYSDDEPFKPWKGLQTNFRLLKRRLREILQ (italic:

nucleic acid editing domain)

Human APOBEC-1
(SEQ ID NO: 286)
MTSEKGPSTGDPTLRRRIEPWEFDVFYDPRELRKEACLLYEIKWGMSRKIWRSSGKNTTNHVEVNFIKK

FTSERDFHPSMSCSITWFLSWSPCWECSQAIREFLSRHPGVTLVIYVARLFWHMDQQNRQGLRDLVNS

GVTIQIMRASEYYHCWRNFVNYPPGDEAHWPQYPPLWMMLYALELHCIILSLPPCLKISRRWQNHLTF

FRLHLQNCHYQTIPPHILLATGLIHPSVAWR

Mouse APOBEC-1
(SEQ ID NO: 287)
mSSETGPVAVDPTLRRRIEPHEFEVFFDPRELRK*ETC*LLYEINWGGRHSVWRHTSQNTSNHVEVNFLEK

FTTERYFRPNTRCSITWFLSWSPCGECSRAITEFLSRHPYVTLFIYIARLYHHTDQRNRQGLRDLISSGVTI

QIMTEQEYCYCWRNFVNYPPSNEAYWPRYPHLWVKLYVLELYCIILGLPPCLKILRRKQPQLTFFTITL

QTCHYQRIPPHLLWATGLK

Rat APOBEC-1
(SEQ ID NO: 288)
MSSETGPVAVDPTLRRRIEPHEFEVFFDPRELRK*ETC*LLYEINWGGRHSIWRHTSQNTNKHVEVNFIEKF

TTERYFCPNTRCSITWFLSWSPCGECSRAITEFLSRYPHVTLFIYIARLYHHADPRNRQGLRDLISSGVTI

-continued

QIMTEQESGYCWRNFVNYSPSNEAHWPRYPHLWVRLYVLELYCIILGLPPCLNILRRKQPQLTFFTIALQ

SCHYQRLPPHILWATGLK

Human APOBEC-2:
(SEQ ID NO: 2491)
MAQKEEAAVATEAASQNGEDLENLDDPEKLKELIELPPFEIVTGERLPANFFKFQFRNVEYSSGRNKTF

LCYVVEAQGKGGQVQASRGYLEDEHAAAHAEEAFFNTILPAFDPALRYNVTWYVSSSPCAACADRIIK

TLSKTKNLRLLILVGRLFMWEEPEIQAALKKLKEAGCKLRIMKPQDFEYVWQNFVEQEEGESKAFQPW

EDIQENFLYYEEKLADILK

Mouse APOBEC-2:
(SEQ ID NO: 2492)
MAQKEEAAEAAAPASQNGDDLENLEDPEKLKELIDLPPFEIVTGVRLPVNFFKFQFRNVEYSSGRNKTF

LCYVVEVQSKGGQAQATQGYLEDEHAGAHAEEAFFNTILPAFDPALKYNVTWYVSSSPCAACADRIL

KTLSKTKNLRLLILVSRLFMWEEPEVQAALKKLKEAGCKLRIMKPQDFEYIWQNFVEQEEGESKAFEP

WEDIQENFLYYEEKLADILK

Rat APOBEC-2:
(SEQ ID NO: 2493)
MAQKEEAAEAAAPASQNGDDLENLEDPEKLKELIDLPPFEIVTGVRLPVNFFKFQFRNVEYSSGRNKTF

LCYVVEAQSKGGQVQATQGYLEDEHAGAHAEEAFFNTILPAFDPALKYNVTWYVSSSPCAACADRIL

KTLSKTKNLRLLILVSRLFMWEEPEVQAALKKLKEAGCKLRIMKPQDFEYLWQNFVEQEEGESKAFEP

WEDIQENFLYYEEKLADILK

Bovine APOBEC-2:
(SEQ ID NO: 2494)
MAQKEEAAAAAEPASQNGEEVENLEDPEKLKELIELPPFEIVTGERLPAHYFKFQFRNVEYSSGRNKTF

LCYVVEAQSKGGQVQASRGYLEDEHATNHAEEAFFNSIMPTFDPALRYMVTWYVSSSPCAACADRIV

KTLNKTKNLRLLILVGRLFMWEEPEIQAALRKLKEAGCRLRIMKPQDFEYIWQNFVEQEEGESKAFEP

WEDIQENFLYYEEKLADILK

*Petromyzon marinus* CDA1 (pmCDA1)
(SEQ ID NO: 289)
MTDAEYVRIHEKLDIYTFKKQFFNNKKSVSHRCYVLFELKRRGERRACFWGYAVNKPQSGTERGIHAE

IFSIRKVEEYLRDNPGQFTINWYSSWSPCADCAEKILEWYNQELRGNGHTLKIWACKLYYEKNARNQI

GLWNLRDNGVGLNVMVSEHYQCCRKIFIQSSHNQLNENRWLEKTLKRAEKRRSELSIMIQVKILHTTK

SPAV

Human APOBEC3G D316R_D317R
(SEQ ID NO: 290)
MKPHFRNTVERMYRDTFSYNFYNRPILSRRNTVWLCYEVKTKGPSRPPLDAKIFRGQVYSELKYHPEM

RFFHWFSKWRKLHRDQEYEVTWYISWSPCTKCTRDMATFLAEDPKVTLTIFVARLYYFWDPDYQEAL

RSLCQKRDGPRATMKIMNYDEFQHCWSKFVYSQRELFEPWNNLPKYYILLHIMLGEILRHSMDPPTFTF

NFNNEPWVRGRHETYLCYEVERMHNDTWVLLNQRRGFLCNQAPHKHGFLEGRHAELCFLDVIPFWK

LDLDQDYRVTCFTSWSPCFSCAQEMAKFISKNKHVSLCIFTARIYRRQGRCQEGLRTLAEAGAKISIMT

YSEFKHCWDTFVDHQGCPFQPWDGLDEHSQDLSGRLRAILQNQEN

Human APOBEC3G chain A
(SEQ ID NO: 291)
MDPPTFTFNFNNEPWVRGRHETYLCYEVERMHNDTWVLLNQRRGFLCNQAPHKHGFLEGRHAELCFL

DVIPFWKLDLDQDYRVTCFTSWSPCFSCAQEMAKFISKNKHVSLCIFTARIYDDQGRCQEGLRTLAEAG

AKISIMTYSEFKHCWDTFVDHQGCPFQPWDGLDEHSQDLSGRLRAILQ

-continued

Human APOBEC3G chain A D120R_D121R
(SEQ ID NO: 292)
MDPPTFTFNFNNEPWVRGRHETYLCYEVERMHNDTWVLLNQRRGFLCNQAPHKHGFLEGRHAELCFL

DVIPFWKLDLDQDYRVTCFTSWSPCFSCAQEMAKFISKNKHVSLCIFTARIYRRQGRCQEGLRTLAEAG

AKISIMTYSEFKHCWDTFVDHQGCPFQPWDGLDEHSQDLSGRLRAILQ

Non-limiting examples of fusion proteins/nucleobase editors are provided.
His$_6$-rAPOBEC1-XTEN-dCas9 for *Escherichia coli* expression
(SEQ ID NO: 293)
MGSSHHHHHHMSSETGPVAVDPTLRRRIEPHEFEVFFDPRELRKETCLLYEINWGGRHSIWRHTSQNTN

KHVEVNFIEKFTTERYFCPNTRCSITWFLSWSPCGECSRAITEFLSRYPHVTLFIYIARLYHHADPRNRQG

LRDLISSGVTIQIMTEQESGYCWRNFVNYSPSNEAHWPRYPHLWVRLYVLELYCIILGLPPCLNILRRKQ

PQLTFFTIALQSCHYQRLPPHILWATGLKSGSETPGTSESATPESDKKYSIGLAIGTNSVGWAVITDEYK

VPSKKFKVLGNTDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRLIYLALAHMIKFR

GHFLIEGDLNPDNSDVDKLFIQLVQTYNQLFEENPINASGVDAKAILSARLSKSRRLENLIAQLPGEKKN

GLFGNLIALSLGLTPNFKSNFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQSKNGYAGYIDGGASQEEFY

KFIKPILEKMDGTEELLVKLNREDLLRKQRTFDNGSIPHQIHLGELHAILRRQEDFYPFLKDNREKIEKIL

TFRIPYYVGPLARGNSRFAWMTRKSEETITPWNFEEVVDKGASAQSFIERMTNFDKNLPNEKVLPKHSL

LYEYFTVYNELTKVKYVTEGMRKPAFLSGEQKKAIVDLLFKTNRKVTVKQLKEDYFKKIECFDSVEIS

GVEDRFNASLGTYHDLLKIIKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDDSLTFKEDIQKAQVSGQGDS

LHEHIANLAGSPAIKKGILQTVKVVDELVKVMGRHKPENIVIEMARENQTTQKGQKNSRERMKRIEEGI

KELGSQILKEHPVENTQLQNEKLYLYYLQNGRDMYVDQELDINRLSDYDVDAIVPQSFLKDDSIDNKV

LTRSDKNRGKSDNVPSEEVVKKMKNYWRQLLNAKLITQRKFDNLTKAERGGLSELDKAGFIKRQLVE

TRQITKHVAQILDSRMNTKYDENDKLIREVKVITLKSKLVSDFRKDFQFYKVREINNYHHAHDAYLNA

VVGTALIKKYPKLESEFVYGDYKVYDVRKMIAKSEQEIGKATAKYFFYSNIMNFFKTEITLANGEIRKR

PLIETNGETGEIVWDKGRDFATVRKVLSMPQVNIVKKTEVQTGGFSKESILPKRNSDKLIARKKDWDPK

KYGGFDSPTVAYSVLVVAKVEKGKSKKLKSVKELLGITIMERSSFEKNPIDFLEAKGYKEVKKDLIIKLP

KYSLFELENGRKRMLASAGELQKGNELALPSKYVNFLYLASHYEKLKGSPEDNEQKQLFVEQHKHYL

DEIIEQISEFSKRVILADANLDKVLSAYNKHRDKPIREQAENIIHLFTLTNLGAPAAFKYFDTTIDRKRYT

STKEVLDATLIHQSITGLYETRIDLSQLGGDSGGSPKKKRKV rAPOBEC1-XTEN-dCas9-NLS for mammalian expression
(SEQ ID NO: 294)
MSSETGPVAVDPTLRRRIEPHEFEVFFDPRELRKETCLLYEINWGGRHSIWRHTSQNTNKHVEVNFIEKF

TTERYFCPNTRCSITWFLSWSPCGECSRAITEFLSRYPHVTLFIYIARLYHHADPRNRQGLRDLISSGVTI

QIMTEQESGYCWRNFVNYSPSNEAHWPRYPHLWVRLYVLELYCIILGLPPCLNILRRKQPQLTFFTIALQ

SCHYQRLPPHILWATGLKSGSETPGTSESATPESDKKYSIGLAIGTNSVGWAVITDEYKVPSKKFKVLG

NTDRHSIKKNLIGALLFDSGETALATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYLALAHMIKFRGHFLIEGDLN

PDNSDVDKLFIQLVQTYNQLFEENPINASGVDAKAILSARLSKSRRLENLIAQLPGEKKNGLFGNLIALS

LGLTPNFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEFYKFIKPILEKM

DGTEELLVKLNREDLLRKQRTFDNGSIPHQIHLGELHAILRRQEDFYPFLKDNREKIEKILTFRIPYYVGP

-continued

LARGNSRFAWMTRKSEETITPWNFEEVVDKGASAQSFIERMTNFDKNLPNEKVLPKHSLLYEYFTVYN

ELTKVKYVTEGMRKPAFLSGEQKKAIVDLLFKTNRKVTVKQLKEDYFKKIECFDSVEISGVEDRFNASL

GTYHDLLKIIKDKDFLDNEENEDILEDIVLTLTLFEDREMIEERLKTYAHLFDDKVMKQLKRRRYTGWG

RLSRKLINGIRDKQSGKTILDFLKSDGFANRNFMQLIHDDSLTFKEDIQKAQVSGQGDSLHEHIANLAGS

PAIKKGILQTVKVVDELVKVMGRHKPENIVIEMARENQTTQKGQKNSRERMKRIEEGIKELGSQILKEH

PVENTQLQNEKLYLYYLQNGRDMYVDQELDINRLSDYDVDAIVPQSFLKDDSIDNKVLTRSDKNRGKS

DNVPSEEVVKKMKNYWRQLLNAKLITQRKFDNLTKAERGGLSELDKAGFIKRQLVETRQITKHVAQIL

DSRMNTKYDENDKLIREVKVITLKSKLVSDFRKDFQFYKVREINNYHHAHDAYLNAVVGTALIKKYPK

LESEFVYGDYKVYDVRKMIAKSEQEIGKATAKYFFYSNIMNFFKTEITLANGEIRKRPLIETNGETGEIV

WDKGRDFATVRKVLSMPQVNIVKKTEVQTGGFSKESILPKRNSDKLIARKKDWDPKKYGGFDSPTVA

YSVLVVAKVEKGKSKKLKSVKELLGITIMERSSFEKNPIDFLEAKGYKEVKKDLIIKLPKYSLFELENGR

KRMLASAGELQKGNELALPSKYVNFLYLASHYEKLKGSPEDNEQKQLFVEQHKHYLDEIIEQISEFSKR

VILADANLDKVLSAYNKHRDKPIREQAENIIHLFTLTNLGAPAAFKYFDTTIDRKRYTSTKEVLDATLIH

QSITGLYETRIDLSQLGGDSGGSPKKKRKV hAPOBEC1-XTEN-dCas9-NLS for mammalian expression
(SEQ ID NO: 295)
MTSEKGPSTGDPTLRRRIEPWEFDVFYDPRELRKEACLLYEIKWGMSRKIWRSSGKNTTNHVEVNFIKK

FTSERDFHPSMSCSITWFLSWSPCWECSQAIREFLSRHPGVTLVIYVARLFWHMDQQNRQGLRDLVNS

GVTIQIMRASEYYHCWRNFVNYPPGDEAHWPQYPPLWMMLYALELHCIILSLPPCLKISRRWQNHLTF

FRLHLQNCHYQTIPPHILLATGLIHPSVAWRSGSETPGTSESATPESDKKYSIGLAIGTNSVGWAVITDEY

KVPSKKFKVLGNTDRHSIKKNLIGALLFDSGETALATRLKRTARRRYTRRKNRICYLQEIFSNEMAKVD

DSFFHRLEESFLVEEDKKHERHPIFGNIVDEVAYHEKYPTIYHLRKKLVDSTDKADLRLIYLALAHMIKF

RGHFLIEGDLNPDNSDVDKLFIQLVQTYNQLFEENPINASGVDAKAILSARLSKSRRLENLIAQLPGEKK

NGLFGNLIALSLGLTPNFKSNFDLAEDAKLQLSKDTYDDDLDNLLAQIGDQYADLFLAAKNLSDAILLS

DILRVNTEITKAPLSASMIKRYDEHHQDLTLLKALVRQQLPEKYKEIFFDQSKNGYAGYIDGGASQLEF

YKFIKPILEKMDGTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFDSVEIS

GVEDRFNASLGTYHDLLKIIKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDDSLTFKEDIQKAQVSGQGDS

LHEHIANLAGSPAIKKGILQTVKVVDELVKVMGRHKPENIVIEMARENQTTQKGQKNSRERMKRIEEGI

KELGSQILKEHPVENTQLQNEKLYLYYLQNGRDMYVDQELDINRLSDYDVDAIVPQSFLKDDSIDNKV

LTRSDKNRGKSDNVPSEEVVKKMKNYWRQLLNAKLITQRKFDNLTKAERGGLSELDKAGFIKRQLVE

TRQITKHVAQILDSRMNTKYDENDKLIREVKVITLKSKLVSDFRKDFQFYKVREINNYHHAHDAYLNA

VVGTALIKKYPKLESEFVYGDYKVYDVRKMIAKSEQEIGKATAKYFFYSNIMNFFKTEITLANGEIRKR

PLIETNGETGEIVWDKGRDFATVRKVLSMPQVNIVKKTEVQTGGFSKESILPKRNSDKLIARKKDWDPK

KYGGFDSPTVAYSVLVVAKVEKGKSKKLKSVKELLGITIMERSSFEKNPIDFLEAKGYKEVKKDLIIKLP

KYSLFELENGRKRMLASAGELQKGNELALPSKYVNFLYLASHYEKLKGSPEDNEQKQLFVEQHKHYL

DEIIEQISEFSKRVILADANLDKVLSAYNKHRDKPIREQAENIIHLFTLTNLGAPAAFKYFDTTIDRKRYT

STKEVLDATLIHQSITGLYETRIDLSQLGGDSGGSPKKKRKV

-continued rAPOBEC1-XTEN-dCas9-UGI-NLS (SEQ ID NO: 296)

MSSETGPVAVDPTLRRRIEPHEFEVFFDPRELRKETCLLYEINWGGRHSIWRHTSQNTNKHVEVNFIEKF

TTERYFCPNTRCSITWFLSWSPCGECSRAITEFLSRYPHVTLFIYIARLYHHADPRNRQGLRDLISSGVTI

QIMTEQESGYCWRNFVNYSPSNEAHWPRYPHLWVRLYVLELYCIILGLPPCLNILRRKQPQLTFFTIALQ

SCHYQRLPPHILWATGLKSGSETPGTSESATPESDKKYSIGLAIGTNSVGWAVITDEYKVPSKKFKVLG

NTDRHSIKKNLIGALLFDSGETALATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYLALAHMIKFRGHFLIEGDLN

PDNSDVDKLFIQLVQTYNQLFEENPINASGVDAKAILSARLSKSRRLENLIAQLPGEKKNGLFGNLIALS

LGLTPNFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQLEFYKFIKPILEKM

DGTEELLVKLNREDLLRKQRTFDNGSIPHQIHLGELHAILRRQEDFYPFLKDNREKIEKILTFRIPYYVGP

LARGNSRFAWMTRKSEETITPWNFEEVVDKGASAQSFIERMTNFDKNLPNEKVLPKHSLLYEYFTVYN

ELTKVKYVTEGMRKPAFLSGEQKKAIVDLLFKTNRKVTVKQLKEDYFKKIECFDSVEISGVEDRFNASL

GTYHDLLKIIKDKDFLDNEENEDILEDIVLTLTLFEDREMIEERLKTYAHLFDDKVMKQLKRRRYTGWG

RLSRKLINGIRDKQSGKTILDFLKSDGFANRNFMQLIHDDSLTFKEDIQKAQVSGQGDSLHEHIANLAGS

PAIKKGILQTVKVVDELVKVMGRHKPENIVIEMARENQTTQKGQKNSRERMKRIEEGIKELGSQILKEH

PVENTQLQNEKLYLYYLQNGRDMYVDQELDINRLSDYDVDAIVPQSFLKDDSIDNKVLTRSDKNRGKS

DNVPSEEVVKKMKNYWRQLLNAKLITQRKFDNLTKAERGGLSELDKAGFIKRQLVETRQITKHVAQIL

DSRMNTKYDENDKLIREVKVITLKSKLVSDFRKDFQFYKVREINNYHHAHDAYLNAVVGTALIKKYPK

LESEFVYGDYKVYDVRKMIAKSEQEIGKATAKYFFYSNIMNFFKTEITLANGEIRKRPLIETNGETGEIV

WDKGRDFATVRKVLSMPQVNIVKKTEVQTGGFSKESILPKRNSDKLIARKKDWDPKKYGGFDSPTVA

YSVLVVAKVEKGKSKKLKSVKELLGITIMERSSFEKNPIDFLEAKGYKEVKKDLIIKLPKYSLFELENGR

KRMLASAGELQKGNELALPSKYVNFLYLASHYEKLKGSPEDNEQKQLFVEQHKHYLDEIIEQISEFSKR

VILADANLDKVLSAYNKHRDKPIREQAENIIHLFTLTNLGAPAAFKYFDTTIDRKRYTSTKEVLDATLIH

QSITGLYETRIDLSQLGGDSGGSTNLSDIIEKETGKQLVIQESILMLPEEVEEVIGNKPESDILVHTAYDES

TDENVMLLTSDAPEYKPWALVIQDSNGENKIKMLSGGSPKKKRKV rAPOBEC1-XTEN-Cas9 nickase-UGI-NLS (BE3, SEQ ID NO: 297)

MSSETGPVAVDPTLRRRIEPHEFEVFFDPRELRKETCLLYEINWGGRHSIWRHTSQNTNKHVEVNFIEKF

TTERYFCPNTRCSITWFLSWSPCGECSRAITEFLSRYPHVTLFIYIARLYHHADPRNRQGLRDLISSGVTI

QIMTEQESGYCWRNFVNYSPSNEAHWPRYPHLWVRLYVLELYCIILGLPPCLNILRRKQPQLTFFTIALQ

SCHYQRLPPHILWATGLKSGSETPGTSESATPESDKKYSIGLAIGTNSVGWAVITDEYKVPSKKFKVLG

NTDRHSIKKNLIGALLFDSGETALATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYLALAHMIKFRGHFLIEGDLN

PDNSDVDKLFIQLVQTYNQLFEENPINASGVDAKAILSARLSKSRRLENLIAQLPGEKKNGLFGNLIALS

LGLTPNFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQLEFYKFIKPILEKM

DGTEELLVKLNREDLLRKQRTFDNGSIPHQIHLGELHAILRRQEDFYPFLKDNREKIEKILTFRIPYYVGP

LARGNSRFAWMTRKSEETITPWNFEEVVDKGASAQSFIERMTNFDKNLPNEKVLPKHSLLYEYFTVYN

ELTKVKYVTEGMRKPAFLSGEQKKAIVDLLFKTNRKVTVKQLKEDYFKKIECFDSVEISGVEDRFNASL

GTYHDLLKIIKDKDFLDNEENEDILEDIVLTITLFEDREMIEERLKTYAHLFDDKVMKQLKRRRYTGWG

```
RLSRKLINGIRDKQSGKTILDFLKSDGFANRNFMQLIHDDSLTFKEDIQKAQVSGQGDSLHEHIANLAGS

PAIKKGILQTVKVVDELVKVMGRHKPENIVIEMARENQTTQKGQKNSRERMKRIEEGIKELGSQILKEH

PVENTQLQNEKLYLYYLQNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIKRQLVETRQITKHVAQIL

DSRMNTKYDENDKLIREVKVITLKSKLVSDFRKDFQFYKVREINNYHHAHDAYLNAVVGTALIKKYPK

LESEFVYGDYKVYDVRKMIAKSEQEIGKATAKYFFYSNIMNFFKTEITLANGEIRKRPLIETNGETGEIV

WDKGRDFATVRKVLSMPQVNIVKKTEVQTGGFSKESILPKRNSDKLIARKKDWDPKKYGGFDSPTVA

YSVLVVAKVEKGKSKKLKSVKELLGITIMERSSFEKNPIDFLEAKGYKEVKKDLIIKLPKYSLFELENGR

KRMLASAGELQKGNELALPSKYVNFLYLASHYEKLKGSPEDNEQKQLFVEQHKHYLDEIIEQISEFSKR

VILADANLDKVLSAYNKHRDKPIREQAENIIHLFTLTNLGAPAAFKYFDTTIDRKRYTSTKEVLDATLIH

QSITGLYETRIDLSQLGGDSGGSTNLSDIIEKETGKQLVIQESILMLPEEVEEVIGNKPESDILVHTAYDES

TDENVMLLTSDAPEYKPWALVIQDSNGENKIKMLSGGSPKKKRKV pmCDA1-XTEN-dCas9-UGI (bacteria)
                                                              (SEQ ID NO: 298)
MTDAEYVRIHEKLDIYTFKKQFFNNKKSVSHRCYVLFELKRRGERRACFWGYAVNKPQSGTERGIHAE

IFSIRKVELYLRDNPGQFTINWYSSWSPCADCALKILEWYNQELRGNGHTLKIWACKLYYEKNARNQI

GLWNLRDNGVGLNVMVSEHYQCCRKIFIQSSHNQLNENRWLEKTLKRAEKRRSELSIMIQVKILHTTK

SPAVSGSETPGTSESATPESDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLEESFLVEEDKKHERHPIFGN

IVDEVAYHEKYPTIYHLRKKLVDSTDKADLRLIYLALAHMIKFRGHFLIEGDLNPDNSDVDKLFIQLVQ

TYNQLFEENPINASGVDAKAILSARLSKSRRLENLIAQLPGEKKNGLFGNLIALSLGLTPNFKSNFDLAE

DAKLQLSKDTYDDDLDNLLAQIGDQYADLFLAAKNLSDAILLSDILRVNTEITKAPLSASMIKRYDEHH

QDLTLLKALVRQQLPEKYKEIFFDQSKNGYAGYIDGGASQLEFYKFIKPILEKMDGTEELLVKLNREDL

LRKQRTFDNGSIPHQIHLGELHAILRRQEDFYPFLKDNREKIEKILTFRIPYYVGPLARGNSRFAWMTRK

SEETITPWNFEEVVDKGASAQSFIERMTNFDKNLPNEKVLPKHSLLYEYFTVYNELTKVKYVTEGMRK

PAFLSGEQKKAIVDLLFKTNRKVTVKQLKEDYFKKIECFDSVEISGVEDRFNASLGTYHDLLKIIKDKDF

LDNEENEDILEDIVLTLTLFEDREMIEERLKTYAHLFDDKVMKQLKRRRYTGWGRLSRKLINGIRDKQS

GKTILDFLKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQNEKLY

LYYLQNGRDMYVDQELDINRLSDYDVDAIVPQSFLKDDSIDNKVLTRSDKNRGKSDNVPSEEVVKKM

KNYWRQLLNAKLITQRKFDNLTKAERGGLSELDKAGFIKRQLVETRQITKHVAQILDSRMNTKYDEND

KLIREVKVITLKSKLVSDFRKDFQFYKVREINNYHHAHDAYLNAVVGTALIKKYPKLESEFVYGDYKV

YDVRKMIAKSEQEIGKATAKYFFYSNIMNFFKTEITLANGEIRKRPLIETNGETGEIVWDKGRDFATVRK

VLSMPQVNIVKKTEVQTGGFSKESILPKRNSDKLIARKKDWDPKKYGGFDSPTVAYSVLVVAKVEKGK

SKKLKSVKELLGITIMERSSFEKNPIDFLEAKGYKEVKKDLIIKLPKYSLFELENGRKRMLASAGELQKG

NELALPSKYVNFLYLASHYEKLKGSPEDNEQKQLFVEQHKHYLDEIIEQISEFSKRVILADANLDKVLSA

YNKHRDKPIREQAENIIHLFTLTNLGAPAAFKYFDTTIDRKRYTSTKEVLDATLIHQSITGLYETRIDLSQ

LGGDSGGSMTNLSDIIEKETGKQLVIQESILMLPEEVELVIGNKPESDILVHTAYDESTDENVMLLTSDA

PEYKPWALVIQDSNGENKIKML pmCDA1-XTEN-nCas9-UGI-NLS (mammalian construct)
                                                              (SEQ ID NO: 299)
MTDAEYVRIHEKLDIYTFKKQFFNNKKSVSHRCYVLFELKRRGERRACFWGYAVNKPQSGTERGIHAE

IFSIRKVELYLRDNPGQFTINWYSSWSPCADCALKILEWYNQELRGNGHTLKIWACKLYYEKNARNQI
```

```
GLWNLRDNGVGLNVMVSEHYQCCRKIFIQSSHNQLNENRWLEKTLKRAEKRRSELSIMIQVKILHTTK

SPAVSGSETPGTSESATPESDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLEESFLVEEDKKHERHPIFGN

IVDEVAYHEKYPTIYHLRKKLVDSTDKADLRLIYLALAHMIKFRGHFLIEGDLNPDNSDVDKLFIQLVQ

TYNQLFEENPINASGVDAKAILSARLSKSRRLENLIAQLPGEKKNGLFGNLIALSLGLTPNFKSNFDLAE

DAKLQLSKDTYDDDLDNLLAQIGDQYADLFLAAKNLSDAILLSDILRVNTEITKAPLSASMIKRYDEHH

QDLTLLKALVRQQLPEKYKEIFFDQSKNGYAGYIDGGASQLEFYKFIKPILEKMDGTEELLVKLNREDL

LRKQRTFDNGSIPHQIHLGELHAILRRQEDFYPFLKDNREKIEKILTFRIPYYVGPLARGNSRFAWMTRK

SEETITPWNFEEVVDKGASAQSFIERMTNFDKNLPNEKVLPKHSLLYEYFTVYNELTKVKYVTEGMRK

PAFLSGEQKKAIVDLLFKTNRKVTVKQLKEDYFKKIECFDSVEISGVEDRFNASLGTYHDLLKIIKDKDF

LDNEENEDILEDIVLTLTLFEDREMIEERLKTYAHLFDDKVMKQLKRRYTGWGRLSRKLINGIRDKQS

GKTILDFLKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQNEKLY

LYYLQNGRDMYVDQELDINRLSDYDVDHIVPQSFLKDDSIDNKVLTRSDKNRGKSDNVPSEEVVKKM

KNYWRQLLNAKLITQRKFDNLTKAERGGLSELDKAGFIKRQLVETRQITKHVAQILDSRMNTKYDEND

KLIREVKVITLKSKLVSDFRKDFQFYKVREINNYHHAHDAYLNAVVGTALIKKYPKLESEFVYGDYKV

YDVRKMIAKSEQEIGKATAKYFFYSNIMNFFKTEITLANGEIRKRPLIETNGETGEIVWDKGRDFATVRK

VLSMPQVNIVKKTEVQTGGFSKESILPKRNSDKLIARKKDWDPKKYGGFDSPTVAYSVLVVAKVEKGK

SKKLKSVKELLGITIMERSSFEKNPIDFLEAKGYKEVKKDLIIKLPKYSLFELENGRKRMLASAGELQKG

NELALPSKYVNFLYLASHYEKLKGSPEDNEQKQLFVEQHKHYLDEIIEQISEFSKRVILADANLDKVLSA

YNKHRDKPIREQAENIIHLFTLTNLGAPAAFKYFDTTIDRKRYTSTKEVLDATLIHQSITGLYETRIDLSQ

LGGDSGGSTNLSDIIEKETGKQLVIQESILMLPEEVEEVIGNKPESDILVHTAYDESTDENVMLLTSDAPE

YKPWALVIQDSNGENKIKMLSGGSPKKKRKV huAPOBEC3G-XTEN-dCas9-UGI (bacteria)
                                                              (SEQ ID NO: 300)
MDPPTFTFNFNNEPWVRGRHETYLCYEVERMHNDTWVLLNQRRGFLCNQAPHKHGFLEGRHAELCFL

DVIPFWKLDLDQDYRVTCFTSWSPCFSCAQEMAKFISKNKHVSLCIFTARIYDDQGRCQEGLRTLAEAG

AKISIMTYSEFKHCWDTFVDHQGCPFQPWDGLDEHSQDLSGRLRAILQSGSETPGTSESATPESDKKYSI

GLAIGTNSVGWAVITDEYKVPSKKFKVLGNTDRHSIKKNLIGALLFDSGETALATRLKRTARRRYTRRK

NRICYLQEIFSNEMAKVDDSFFHRLEESFLVEEDKKHERHPIFGNIVDEVAYHEKYPTIYHLRKKLVDST

DKADLRLIYLALAHMIKFRGHFLIEGDLNPDNSDVDKLFIQLVQTYNQLFEENPINASGVDAKAILSARL

SKSRRLENLIAQLPGEKKNGLFGNLIALSLGLTPNFKSNFDLAEDAKLQLSKDTYDDDLDNLLAQIGDQ

YADLFLAAKNLSDAILLSDILRVNTEITKAPLSASMIKRYDEHHQDLTLLKALVRQQLPEKYKEIFFDQS

KNGYAGYIDGGASQLEFYKFIKPILEKMDGTEELLVKLNREDLLRKQRTFDNGSIPHQIHLGELHAILRR

QEDFYPFLKDNREKIEKILTFRIPYYVGPLARGNSRFAWMTRKSEETITPWNFEEVVDKGASAQSFIERM

TNFDKNLPNEKVLPKHSLLYEYFTVYNELTKVKYVTEGMRKPAFLSGEQKKAIVDLLFKTNRKVTVK

QLKEDYFKKIECFDSVEISGVEDRFNASLGTYHDLLKIIKDKDFLDNEENEDILEDIVLTLTLFEDREMIE

ERLKTYAHLFDDKVMKQLKRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVMGRHKPENIVIEMARENQTT

QKGQKNSRERMKRIEEGIKELGSQILKEHPVENTQLQNEKLYLYYLQNGRDMYVDQELDINRLSDYDV

DAIVPQSFLKDDSIDNKVLTRSDKNRGKSDNVPSEEVVKKMKNYWRQLLNAKLITQRKFDNLTKAER
```

```
GGLSELDKAGFIKRQLVETRQITKHVAQILDSRMNTKYDENDKLIREVKVITLKSKLVSDFRKDFQFYK

VREINNYHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGGFSKESILP

KRNSDKLIARKKDWDPKKYGGFDSPTVAYSVLVVAKVEKGKSKKLKSVKELLGITIMERSSFEKNPIDF

LEAKGYKEVKKDLIIKLPKYSLFELENGRKRMLASAGELQKGNELALPSKYVNFLYLASHYEKLKGSP

EDNEQKQLFVEQHKHYLDEIIEQISEFSKRVILADANLDKVLSAYNKHRDKPIREQAENIIHLFTLTNLG

APAAFKYFDTTIDRKRYTSTKEVLDATLIHQSITGLYETRIDLSQLGGDSGGSMTNLSDIIEKETGKQLVI

QESILMLPEEVEEVIGNKPESDILVHTAYDESTDENVMLLTSDAPEYKPWALVIQDSNGENKIKML
``` huAPOBEC3G-XTEN-nCas9-UGI-NLS (mammalian construct)
(SEQ ID NO: 301)

```
MDPPTFTFNFNNEPWVRGRHETYLCYEVERMHNDTWVLLNQRRGFLCNQAPHKHGFLEGRHAELCFL

DVIPFWKLDLDQDYRVTCFTSWSPCFSCAQEMAKFISKNKHVSLCIFTARIYDDQGRCQEGLRTLAEAG

AKISIMTYSEFKHCWDTFVDHQGCPFQPWDGLDEHSQDLSGRLRAILQSGSETPGTSESATPESDKKYSI

GLAIGTNSVGWAVITDEYKVPSKKFKVLGNTDRHSIKKNLIGALLFDSGETALATRLKRTARRRYTRRK

NRICYLQEIFSNEMAKVDDSFFHRLEESFLVEEDKKHERHPIFGNIVDEVAYHEKYPTIYHLRKKLVDST

DKADLRLIYLALAHMIKFRGHFLIEGDLNPDNSDVDKLFIQLVQTYNQLFEENPINASGVDAKAILSARL

SKSRRLENLIAQLPGEKKNGLFGNLIALSLGLTPNFKSNFDLAEDAKLQLSKDTYDDDLDNLLAQIGDQ

YADLFLAAKNLSDAILLSDILRVNTEITKAPLSASMIKRYDEHHQDLTLLKALVRQQLPEKYKEIFFDQS

KNGYAGYIDGGASQLEFYKFIKPILEKMDGTEELLVKLNREDLLRKQRTFDNGSIPHQIHLGELHAILRR

QEDFYPFLKDNREKIEKILTFRIPYYVGPLARGNSRFAWMTRKSEETITPWNFEEVVDKGASAQSFIERM

TNFDKNLPNEKVLPKHSLLYEYFTVYNELTKVKYVTEGMRKPAFLSGEQKKAIVDLLFKTNRKVTVK

QLKEDYFKKIECFDSVEISGVEDRFNASLGTYHDLLKIIKDKDFLDNEENEDILEDIVLTLTLFEDREMIE

ERLKTYAHLFDDKVMKQLKRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVMGRHKPENIVIEMARENQTT

QKGQKNSRERMKRIEEGIKELGSQILKEHPVENTQLQNEKLYLYYLQNGRDMYVDQELDINRLSDYDV

DHIVPQSFLKDDSIDNKVLTRSDKNRGKSDNVPSEEVVKKMKNYWRQLLNAKLITQRKFDNLTKAER

GGLSELDKAGFIKRQLVETRQITKHVAQILDSRMNTKYDENDKLIREVKVITLKSKLVSDFRKDFQFYK

VREINNYHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGGFSKESILP

KRNSDKLIARKKDWDPKKYGGFDSPTVAYSVLVVAKVEKGKSKKLKSVKELLGITIMERSSFEKNPIDF

LEAKGYKEVKKDLIIKLPKYSLFELENGRKRMLASAGELQKGNELALPSKYVNFLYLASHYEKLKGSP

EDNEQKQLFVEQHKHYLDEIIEQISEFSKRVILADANLDKVLSAYNKHRDKPIREQAENIIHLFTLTNLG

APAAFKYFDTTIDRKRYTSTKEVLDATLIHQSITGLYETRIDLSQLGGDSGGSTNLSDIIEKETGKQLVIQ

ESILMLPEEVEEVIGNKPESDILVHTAYDESTDENVMLLTSDAPEYKPWALVIQDSNGENKIKMLSGGSP

KKKRKV
``` huAPOBEC3G (D316R_D317R)-XTEN-nCas9-UGI-NLS (mammalian construct)
(SEQ ID NO: 302)

```
MDPPTFTFNFNNEPWVRGRHETYLCYEVERMHNDTWVLLNQRRGFLCNQAPHKHGFLEGRHAELCFL

DVIPFWKLDLDQDYRVTCFTSWSPCFSCAQEMAKFISKNKHVSLCIFTARIYRRQGRCQEGLRTLAEAG

AKISIMTYSEFKHCWDTFVDHQGCPFQPWDGLDEHSQDLSGRLRAILQSGSETPGTSESATPESDKKYSI

GLAIGTNSVGWAVITDEYKVPSKKFKVLGNTDRHSIKKNLIGALLFDSGETALATRLKRTARRRYTRRK

NRICYLQEIFSNEMAKVDDSFFHRLEESFLVEEDKKHERHPIFGNIVDEVAYHEKYPTIYHLRKKLVDST

DKADLRLIYLALAHMIKFRGHFLIEGDLNPDNSDVDKLFIQLVQTYNQLFEENPINASGVDAKAILSARL
```

-continued

```
SKSRRLENLIAQLPGEKKNGLFGNLIALSLGLTPNFKSNFDLAEDAKLQLSKDTYDDDLDNLLAQIGDQ

YADLFLAAKNLSDAILLSDILRVNTEITKAPLSASMIKRYDEHHQDLTLLKALVRQQLPEKYKEIFFDQS

KNGYAGYIDGGASQLEFYKFIKPILEKMDGTEELLVKLNREDLLRKQRTFDNGSIPHQIHLGELHAILRR

QEDFYPFLKDNREKIEKILTFRIPYYVGPLARGNSRFAWMTRKSEETITPWNFEEVVDKGASAQSFIERM

TNFDKNLPNEKVLPKHSLLYEYFTVYNELTKVKYVTEGMRKPAFLSGEQKKAIVDLLFKTNRKVTVK

QLKEDYFKKIECFDSVEISGVEDRFNASLGTYHDLLKIIKDKDFLDNEENEDILEDIVLTLTLFEDREMIE

ERLKTYAHLFDDKVMKQLKRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVMGRHKPENIVIEMARENQTT

QKGQKNSRERMKRIEEGIKELGSQILKEHPVENTQLQNEKLYLYYLQNGRDMYVDQELDINRLSDYDV

DHIVPQSFLKDDSIDNKVLTRSDKNRGKSDNVPSEEVVKKMKNYWRQLLNAKLITQRKFDNLTKAER

GGLSELDKAGFIKRQLVETRQITKHVAQILDSRMNTKYDENDKLIREVKVITLKSKLVSDFRKDFQFYK

VREINNYHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGGFSKESILP

KRNSDKLIARKKDWDPKKYGGFDSPTVAYSVLVVAKVEKGKSKKLKSVKELLGITIMERSSFEKNPIDF

LEAKGYKEVKKDLIIKLPKYSLFELENGRKRMLASAGELQKGNELALPSKYVNFLYLASHYEKLKGSP

EDNEQKQLFVEQHKHYLDEIIEQISEFSKRVILADANLDKVLSAYNKHRDKPIREQAENIIHLFTLTNLG

APAAFKYFDTTIDRKRYTSTKEVLDATLIHQSITGLYETRIDLSQLGGDSGGSTNLSDIIEKETGKQLVIQ

ESILMLPEEVEEVIGNKPESDILVHTAYDESTDENVMLLTSDAPEYKPWALVIQDSNGENKIKMLSGGSP

KKKRKV
```

Base Editor 4 (BE4; APOBEC1-linker(32 aa)-Cas9n(D10A)-linker(9 aa)-UGI-linker(9 aa)-UGI)

(SEQ ID NO: 2495)

```
MSSETGPVAVDPTLRRRIEPHEFEVFFDPRELRKETCLLYEINWGGRHSIWRHTSQNTNKHVEVNFIEKF

TTERYFCPNTRCSITWFLSWSPCGECSRAITEFLSRYPHVTLFIYIARLYHHADPRNRQGLRDLISSGVTI

QIMTEQESGYCWRNFVNYSPSNEAHWPRYPHLWVRLYVLELYCIILGLPPCLNILRRKQPQLTFFTIALQ

SCHYQRLPPHILWATGLKSGGSSGGSSGSETPGTSESATPESSGGSSGGSDKKYSIGLAIGTNSVGWAVI

TDEYKVPSKKFKVLGNTDRHSIKKNLIGALLFDSGETALATRLKRTARRRYTRRKNRICYLQEIFSNEM

AKVDDSFFHRLEESFLVEEDKKHERHPIFGNIVDEVAYHEKYPTIYHLRKKLVDSTDKADLRLIYLALA

HMIKFRGHFLIEGDLNPDNSDVDKLFIQLVQTYNQLFEENPINASGVDAKAILSARLSKSRRLENLIAQL

PGEKKNGLFGNLIALSLGLTPNFKSNFDLAEDAKLQLSKDTYDDDLDNLLAQIGDQYADLFLAAKNLS

DAILLSDILRVNTEITKAPLSASMIKRYDEHHQDLTLLKALVRQQLPEKYKEIFFDQSKNGYAGYIDGGA

SQLEFYKFIKPILEKMDGTEELLVKLNREDLLRKQRTFDNGSIPHQIHLGELHAILRRQEDFYPFLKDNR

EKIEKILTFRIPYYVGPLARGNSRFAWMTRKSEETITPWNFEEVVDKGASAQSFIERMTNFDKNLPNEK

VLPKHSLLYEYFTVYNELTKVKYVTEGMRKPAFLSGEQKKAIVDLLFKTNRKVTVKQLKEDYFKKIEC

FDSVEISGVEDRFNASLGTYHDLLKIIKDKDFLDNEENEDILEDIVLTLTLFEDREMIEERLKTYAHLFDD

KVMKQLKRRRYTGWGRLSRKLINGIRDKQSGKTILDFLKSDGFANRNFMQLIHDDSLTFKEDIQKAQV

SGQGDSLHEHIANLAGSPAIKKGILQTVKVVDELVKVMGRHKPENIVIEMARENQTTQKGQKNSRERM

KRIEEGIKELGSQILKEHPVENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNLTKAERGGLSELDKAGFI

KRQLVETRQITKHVAQILDSRMNTKYDENDKLIREVKVITLKSKLVSDFRKDFQFYKVREINNYHHAH

DAYLNAVVGTALIKKYPKLESEFVYGDYKVYDVRKMIAKSEQEIGKATAKYFFYSNIMNFFKTEITLA

NGEIRKRPLIETNGETGEIVWDKGRDFATVRKVLSMPQVNIVKKTEVQTGGFSKESILPKRNSDKLIARK
```

```
KDWDPKKYGGFDSPTVAYSVLVVAKVEKGKSKKLKSVKELLGITIMERSSFEKNPIDFLEAKGYKEVK

KDLIIKLPKYSLFELENGRKRMLASAGELQKGNELALPSKYVNFLYLASHYEKLKGSPEDNEQKQLFVE

QHKHYLDEIIEQISEFSKRVILADANLDKVLSAYNKHRDKPIREQAENIIHLFTLTNLGAPAAFKYFDTTI

DRKRYTSTKEVLDATLIHQSITGLYETRIDLSQLGGDSGGSGGSGGSTNLSDIIEKETGKQLVIQESILML

PEEVEEVIGNKPESDILVHTAYDESTDENVMLLTSDAPEYKPWALVIQDSNGENKIKMLSGGSGGSGGS

TNLSDIIEKETGKQLVIQESILMLPEEVEEVIGNKPESDILVHTAYDESTDENVMLLTSDAPEYKPWALVI

QDSNGENKIKMLSGGSPKKKRK
```

Example 2: CRISPR/Cas9 Genome/Base-Editing Methods for Modifying Ion Channels in Dorsal Root Ganglia (DRG)

Long-term chronic pain due to trauma and associated with advanced cancer remains an unmet medical need. Management of pain using painkillers is inherently limited by the development of tolerance, physiological dependence, progressive addiction, and potential for overdose. Current health policies in response to the massive demand for painkillers (~80-100 million patients/year in the US) have led to extensive prescription of opioids, inadvertently contributing to broader public challenges associated with substance abuse and drug-related crime. Fundamentally, there is a pressing need for an innovative solution to address chronic pain that is non-addictive, generalizable, and permanent.

A normal physiological outcome of trauma, inflammation, and nerve injury is the induction of gene expression changes in neighboring nociceptive neurons during the period required for healing, for example by facilitating the firing of action potentials by neurons at a lower activation threshold. These gene expression changes underlie the sensations of hyperalgesia (increased pain sensitivity) and allodynia (pain following a normally innocuous stimulus). Chronic pain develops when the enhanced sensitization of sensory neurons becomes irreversibly established and becomes a persistent maladaptive condition. The functional specialization of sensory neurons is driven by the expression of dedicated ion channel genes that fine-tune the membrane polarization to trigger and propagate action potentials in response to stimuli (Table 12).[1] Therefore, in simple terms the etiology of chronic pain can be described as the dysregulated expression of just a few genes in just a few neurons. However, to date, genetic treatments of chronic pain have not been successfully translated into human therapeutics.[2,3]

In general, the types of chronic pain that occur in most parts of the body and the extremities involve afferent neurons of the dorsal root ganglia (DRG), which reside in clusters of nerve cells near the spinal cord and have long axons extending towards the skin, muscles, and organs, etc. (FIG. 1).[1,4] The mechanism of enhanced excitability involves voltage-gated ion channels and background/leak channels that set the resting membrane potential and firing threshold of DRG neurons (Table 12).[1] Under normal conditions, chemical, mechanical, or thermal stimuli are required to activate receptors and ion channels in peripheral nerve endings to initiate action potentials that propagate along the axons of DRG neurons (FIG. 1). Finally, the dendritic termini of the DRG neurons liberate glutamate and substance-P at synapses in the spinal cord dorsal horn, activating second-order neurons that communicate pain signals to the brain.[1]

Described herein is a novel approach to address chronic pain by deploying various genome-editing agents to modify the genes responsible for propagation of pain signals in dysregulated DRG neurons, by selectively targeting the local nerve endings at the sites of pain using neuron-specific viral vectors (FIG. 2). The genome editing reactions described herein can be achieved by any of the major types of genome editing tools: (i) base-editors that catalyze chemical reactions on nucleobases (e.g., cytidine deaminase-Cas9 fusion[5]); (ii) programmable nucleases with DNA cutting activity (e.g., WT Cas9,[6-8] paired Cas9 nickases9 or Fok1-nuclease-dCas[9] fusions,[10,11] or compatible analogs such as Cpf1,[12] NgAgo,[13] etc.); as well as (iii) TALENs, zinc-finger nucleases, etc.[14,15] The best studied example of a neurotropic virus that has potential as a delivery vector for genome editing constructs is Herpes Simplex Virus 1 (HSV-1),[16] which targets nerve endings in vivo and usurps retrograde axon transport to move the viral DNA up to the cell body of DRG neurons.[17] Therefore, using a neurotropic virus as a delivery strategy enables genome editing treatments aimed at the sites of pain, despite the fact that the genetic material within the nuclei of DRG neurons is quite distant and indistinguishable from unrelated cells within each ganglion (FIG. 2).[4] HSV-1 vectors have the additional advantage of packaging a large double-stranded DNA genome (>150 kbp),[18] which can easily accommodate an expression construct for any programmable genome-editing enzyme (4-5 kbp),[19] multiple guide-RNAs, and regulatory sequences. Constructs up to 30 to 40 kbp can be inserted by replacing non-essential genes of HSV-1,16 and alternatively a designed 100 kbp amplicon can be packaged into helper HSV-1 capsids.[20] Examples of other potentially useful neurotropic viruses include the broader herpesviridae group,[21] varicella-zoster, pseudorabies, cytomegalovirus, Epstein-Barr viruses, encephalitis viruses, polio, coxsackie, echo, mumps, measles, and rabies viruses.[22,23]

This genome editing treatment incorporates multiple design elements that achieve precise and selective targeting of genome editing agents to pain-causative neurons, arising from: 1) localized delivery of a non-replicative viral vector that requires synaptic terminals, sparing the bulk of somatic tissues near the pain site, 2) neuron-specific promoters that drive expression of the genome editing construct, and 3) guide-RNA programmed targeting of non-essential ion channel genes exclusively expressed by DRG neurons to spare other types of neurons (efferent neurons, interneurons, etc.). Safety can be further enhanced using high-specificity Cas9 nuclease variants,[9,10,24,25] and guide-RNAs without off-target matches in the human genome,[26,27] as well as limiting the stability, activity, or expression of the construct, etc.[28,29] By contrast, traditional pharmacological modulation of localized DRG neuron signaling would be challenging to achieve using small molecules or antibodies,[30,31] because these spread systemically and must be optimized for selectivity among many similar ion channel isoforms.[32] Therefore, such strategies are still in early development.[33] Pharmacological analgesics and opioids act rapidly but reversibly, while genome editing is essentially permanent, therefore, standard medications may be co-administered over the period required for the delivery vector and the expression construct to take action.

Human DRG neurons constitutively express specific and specialized ion channels that have been implicated in afferent pain signaling,1 and fulfill the required criteria as targets for modulation of chronic pain conditions. Three sodium channels (NaV1.7, NaV1.8, and NaV1.9) are constitutively expressed in DRG neurons, and a fourth gene (NaV1.3) displays elevated expression after nerve injury (Table 12).[1] Genetic evidence from spontaneous mutations of NaV1.7 (SCN9A) in humans,[34-37] and animal models,[38] strongly suggests that the phenotypic outcome of gene ablation, loss-of-function, destabilization of the transcript and/or protein folding will be the eradication of pain transmission,[34-36] without compromising the normal function of the DRG neurons in triggering action potentials reaching a normal membrane depolarization threshold (FIG. 1). Disruption of SCN9A is only desirable at a localized level, because nociception is essentially a protective mechanism from overextension and deformation for our joints and muscles,[34-36] and it is also necessary for our sense of smell.[39] In the extreme, humans presenting homozygous SCN9A loss-of-function mutations present Congenital Insensitivity to Pain (CIP).[34-36] Conversely, gain-of-function mutations in the sodium channels NaV1.7 (SCN9A) or NaV1.8 (SCN10A) cause congenital pain syndromes such as Primary Erythermalgia.[37] Moreover, the SCN9A gene is also involved in itching.[30,40]

Guide sequences for programming the disruption of SCN9A gene using cytidine deaminase base-editors are shown in Tables 2, 4, and 6. Top scoring guide sequences are listed in Tables 7-9. Top-scoring guide-RNAs for Cas9 nuclease and paired nickases are shown in Table 10 and 11. Interestingly, gain-of-function mutations in the sodium channel NaV1.9 (SCN11A) are known to reduce pain transmission,[38,41] which can be potentially replicated using cytosine deamination base-editors. These strategies can be extended to other ion channels expressed in DRG neurons (FIG. 3). Alternative target genes include the voltage-gated calcium channel CaV3.2 (CACNA1H),[42] the calcium-activated chloride channel (ANO1),[43,44] and the hyperpolarization-activated cation channels (HCN1 and HCN2) (Table 12).[45,46] Moreover, these concepts can be further extended by implementing functional genomic screening of guide-RNA libraries in cell lines,[47,48] towards the unbiased identification of new target genes and genomic locations that indirectly modulate the DRG neuron ion channels and other mechanisms.[1]

In conclusion, chronic pain could be permanently suppressed with unprecedented anatomical precision by genome editing treatment of a small number of DRG neurons, which are the root cause of the condition. This new treatment exploits numerous design elements for specificity and safety, and in principle, can be curative. By engaging the distal axon projections of DRG neurons in the region of chronic pain, this approach is both specific and potentially generalizable to theoretically any location in the body to treat dysregulated neuronal firing established by countless sources of trauma, and regardless of the time that may have elapsed since the onset of chronic pain.

TABLE 12

Ion Channel Genes in DRG Neurons Responsible for Pain Propagation

| Channel name | Gene name | Channel type and function | Expression evidence | Target validation evidence |
|---|---|---|---|---|
| $Na_V1.7$ | SCN9A | Tetrodotoxin (TTX)-sensitive rapidly inactivating sodium current | Peripheral neuron specific. Constitutive, and elevated after nerve injury and inflammation | Loss-of-function and gain-of-function mutations |
| $Na_V1.8$ | SCN10A | TTX-resistant slowly inactivating sodium current | DRG specific. Constitutive, and elevated after nerve injury and inflammation | Loss-of-function mutations |
| $Na_V1.9$ | SCN11A | TTX-resistant persistent sodium current | DRG specific. Constitutive, and elevated after nerve injury and inflammation | Gain-of-function mutations |
| $Na_V1.3$ | SCN3A | TTX-sensitive rapidly inactivating sodium current | Elevated expression after axotomy and nerve injury | |
| $Ca_V3.2$ | CACNA1H | T-type calcium current | Constitutive, and elevated after nerve injury and inflammation | KO mice and genetic models |
| HCN1 | HCN1 | Hyperpolarization-activated cation current | Constitutive, and elevated after inflammation and chemotherapy | |
| HCN2 | HCN2 | Hyperpolarization-activated cation current | Constitutive, and elevated after inflammation | |
| Ano1 | ANO1 | Calcium-activated chloride current | Constitutive, and elevated after nerve injury. | |

Human SCN9A primary protein and cDNA sequence alignment. Underlined: examples of residues and codons predicted to produce a premature stop codon, inactivation, loss-of-function, or destabilization of protein folding, as a result of base-editing using a cytidine deaminase-Cas9 construct.

```
gaggagctgaagaggaattaaaatatacaggatgaaaagatggcaatgttgcctccccca
                                         M  A  M  L  P  P  P ggacctcagagctttgtccatttcacaaaacagtctcttgccctcattgaacaacgcatt
 G  P  Q  S  F  V  H  F  T  K  Q  S  L  A  L  I  E  Q  R  I gctgaaagaaaatcaaaggaacccaagaagaaaagaaagatgatgatgaagaagcccca
 A  E  R  K  S  K  E  P  K  E  E  K  K  D  D  D  E  E  A  P aagccaagcagtgacttggaagctggcaaacagctgcccttcatctatggggacattcct
 K  P  S  S  D  L  E  A  G  K  Q  L  P  F  I  Y  G  D  I  P cccggcatggtgtcagagcccctggaggacttggacccctactatgcagacaaaaagact
 P  G  M  V  S  E  P  L  E  D  L  D  P  Y  Y  A  D  K  K  T ttcatagtattgaacaagggaaaacaatcttccgtttcaatgccacacctgctttatat
 F  I  V  L  N  K  G  K  T  I  F  R  F  N  A  T  P  A  L  Y atgctttctcctttcagtcctctaagaagaatatctattaagattttagtacactcctta
 M  L  S  P  F  S  P  L  P  R  I  S  I  K  I  L  V  H  S  L ttcagcatgctcatcatgtgcactattctgacaaactgcatatttatgaccatgaataac
 F  S  M  L  I  M  C  T  I  L  T  N  C  I  F  M  T  M  N  N ccaccggactggaccaaaaatgtcgagtacacttttactggaatatatacttttgaatca
 P  P  D  W  T  K  N  V  E  Y  T  F  T  G  I  Y  T  F  E  S cttgtaaaaatccttgcaagaggcttctgtgtaggagaattcacttttcttcgtgacccg
 L  V  K  I  L  A  R  G  F  C  V  G  E  F  T  F  L  R  D  P tggaactggctggattttgtcgtcattgtttttgcgtatttaacagaattcgtaaaccta
 W  N  W  L  D  F  V  V  I  V  F  A  Y  L  T  E  F  V  N  L ggcaatgtttcagctcttcgaacttcagagtattgagagctttgaaaactatttctgca
 G  N  V  S  A  L  R  T  F  R  V  L  R  A  L  K  T  I  S  V atcccaggcctgaagacaattgtaggggctttgatccagtcagtgaagaagctttctgat
 I  P  G  L  K  T  I  V  G  A  L  I  Q  S  V  K  K  L  S  D gtcatgatcctgactgtgttctgtctgagtgtgtttgcactaattggactacagctgttc
 V  M  I  L  T  V  F  C  L  S  V  F  A  L  I  G  L  Q  L  F atgggaaacctgaagcataaatgttttcgaaattcacttgaaaataatgaaacattagaa
 M  G  N  L  K  H  K  C  F  R  N  S  L  E  N  N  E  T  L  E agcataatgaatacccctagagagtgaagaagactttagaaaatattttattacttggaa
 S  I  M  N  T  L  E  S  E  E  D  F  R  K  Y  F  Y  Y  L  E ggatccaaagatgctctcctttgtggtttcagcacagattcaggtcagtgtccagagggg
 G  S  K  D  A  L  L  C  G  F  S  T  D  S  G  Q  C  P  E  G tacacctgtgtgaaaattggcagaaaccctgattatggctacacgagctttgacactttc
 Y  T  C  V  K  I  G  R  N  P  D  Y  G  Y  T  S  F  D  T  F agctgggccttcttagccttgtttaggctaatgacccaagattactgggaaaacctttac
 S  W  A  F  L  A  L  F  R  L  M  T  Q  D  Y  W  E  N  L  Y caacagacgctgcgtgctgctggcaaaacctacatgatcttctttgtcgtagtgattttc
 Q  Q  T  L  R  A  A  G  K  T  Y  M  I  F  F  V  V  V  I  F ctgggctccttttatctaataaacttgatcctggctgtggttgccatggcatatgaagaa
 L  G  S  F  Y  L  I  N  L  I  L  A  V  V  A  M  A  Y  E  E cagaaccaggcaaacattgaagaagctaaacagaaagaattagaatttcaacagatgtta
 Q  N  Q  A  N  I  E  E  A  K  Q  K  E  L  E  F  Q  Q  M  L gaccgtcttaaaaagagcaagaagaagctgaggcaattgcagcggcagcggctgaatat
 D  P  L  K  K  E  Q  E  E  A  E  A  I  A  A  A  A  A  E  Y acaagtattaggagaagcagaattatgggcctctcagagagttcttctgaaacatccaaa
 T  S  I  R  R  S  R  I  M  G  L  S  E  S  S  S  E  T  S  K ctgagctctaaaagtgctaaagaagaagaaacagaagaaagaaaaagaatcaaagaag
 L  S  S  K  S  A  K  E  R  R  N  R  R  K  K  K  N  Q  K  K ctctccagtggagaggaaaagggagatgctgagaaattgtcgaaatcagaatcagaggac
 L  S  S  G  E  E  K  G  D  A  E  K  L  S  K  S  E  S  E  D agcatcagaagaaaaagtttccaccttggtgtcgaagggcataggcgagcacatgaaaag
 S  I  R  R  K  S  F  H  L  G  V  E  G  H  R  R  A  H  E  K
```

-continued

```
aggttgtgctaccccaatcagtcaccactcagcattcgtggctccttgttttctgcaagg
 R  L  S  I  P  N  Q  S  P  L  S  I  R  G  S  L  F  S  A  R cgaagcagcagaacaagtcttttagtttcaaaggcagaggaagagatataggatctgag
 R  S  S  R  T  S  L  F  S  F  K  G  R  G  R  D  I  G  S  E actgaatttgccgatgatgagcacagcattttggagacaatgagagcagaaggggctca
 T  E  F  A  D  D  E  H  S  I  F  G  D  N  E  S  R  R  G  S ctgtttgtgccccacagacccaggagcgacgcagcagtaacatcagccaagccagtagg
 L  F  V  P  H  R  P  Q  E  R  R  S  S  N  I  S  Q  A  S  R tccccaccaatgctgccggtgaacgggaaaatgcacagtgctgtggactgcaacggtgtg
 S  P  P  M  L  P  V  N  G  K  M  H  S  A  V  D  C  N  G  V gtctccctggttgatggacgctcagccctcatgctccccaatggacagcttctgccagag
 V  S  L  V  D  G  R  S  A  L  M  L  P  N  G  Q  L  L  P  E ggcacgaccaatcaaatacacaagaaaaggcgttgtagttcctatctccttcagaggat
 G  T  T  N  Q  I  H  K  K  R  R  C  S  S  Y  L  L  S  E  D atgctgaatgatcccaacctcagacagagagcaatgagtagagcaagcatattaacaaac
 M  L  N  D  P  N  L  R  Q  R  A  M  S  R  A  S  I  L  T  N actgtggaagaacttgaagagtccagacaaaaatgtccaccttggtggtacagatttgca
 T  V  E  E  L  E  E  S  R  Q  K  C  P  P  W  W  Y  R  F  A cacaaattcttgatctggaattgctctccatattggataaaattcaaaagtgtatctat
 H  K  F  L  I  W  N  C  S  P  Y  W  I  K  F  K  K  C  I  Y tttattgtaatggatcctttgtagatcttgcaattaccatttgcatagttttaaacaca
 F  I  V  M  D  P  F  V  D  L  A  I  T  I  C  I  V  L  N  T ttatttatggctatggaacaccacccaatgactgaggaattcaaaaatgtacttgctata
 L  F  A  M  A  M  E  H  P  M  T  E  E  F  K  N  V  L  A  I ggaaatttggtctttactggaatctttgcagctgaaatggtattaaaactgattgccatg
 G  N  L  V  F  T  G  I  F  A  A  E  M  V  L  K  L  I  A  M gatccatatgagtattccaagtaggctggaatattttgacagccttattgtgacttta
 D  P  Y  E  Y  F  Q  V  G  W  N  I  F  D  S  L  I  V  T  L agtttagtggagctctttctagcagatgtggaaggattgtcagttctgcgatcattcaga
 S  L  V  E  L  F  L  A  D  V  E  G  L  S  V  L  R  S  F  R ctgctccgagtcttcaagttggcaaaatcctggccaacattgaacatgctgattaagatc
 L  L  R  V  P  K  L  A  K  S  W  P  T  L  N  M  L  I  K  I attggtaactcagtaggggctctaggtaacctcaccttagtgttggccatcatcgtcttc
 I  G  N  S  V  G  A  L  G  N  L  T  L  V  L  A  I  I  V  F attttgctgtggtcggcatgcagctcttggtaagagctacaaagaatgtgtctgcaag
 I  F  A  V  V  G  M  Q  L  F  G  K  S  Y  K  E  C  V  C  K atcaatgatgactgtacgctcccacggtggcacatgaacgacttcttccactccttcctg
 I  N  D  D  C  T  L  P  R  W  H  M  N  D  F  F  H  S  F  L attgtgttccgcgtgctgtgtggagagtggatagagaccatgtgggactgtatggaggtc
 I  V  F  R  V  L  C  G  E  W  I  E  T  M  W  D  C  M  E  V gctggtcaagctatgtgccttattgtttacatgatggtcatggtcattggaaacctggtg
 A  G  Q  A  M  C  L  V  I  Y  M  M  V  M  V  I  G  N  L  V gtcctaaacctattctggccttattattgagctcatttagttcagacaatcttacagca
 V  L  N  L  F  L  A  L  L  L  S  S  F  S  S  D  N  L  T  A attgaagaagaccctgatgcaaacaacctccagattgcagtgactagaattaaaaaggga
 I  E  E  D  P  D  A  N  N  L  Q  I  A  V  T  R  I  K  K  G ataaattatgtgaaacaaaccttacgtgaatttattctaaaagcattttccaaaaagcca
 I  N  Y  V  K  Q  T  L  R  E  F  I  L  K  A  F  S  K  K  P aagatttccagggagataagacaagcagaagatctgaatactaagaaggaaaactatatt
 K  I  S  R  E  I  R  Q  A  E  D  L  N  T  K  K  E  N  Y  I tctaaccatacacttgctgaaatgagcaaaggtcacaatttcctcaaggaaaaagataaa
 S  N  H  T  L  A  E  M  S  K  G  H  N  F  L  K  E  K  D  K atcagtggttttggaagcagcgtggacaaacacttgatggaagacagtgatggtcaatca
 I  S  G  F  G  S  S  V  D  K  H  L  M  E  D  S  D  G  Q  S
```

-continued

```
tttattcacaatcccagcctcacagtgacagtgccaattgcacctggggaatccgatttg
 F  I  H  N  P  S  L  T  V  T  V  P  I  A  P  G  E  S  D  L gaaaatatgaatgctgaggaacttagcagtgattcggatagtgaatacagcaaagtgaga
 E  N  M  N  A  E  E  L  S  S  D  S  D  S  E  Y  S  K  V  R ttaaaccggtcaagctcctcagagtgcagcacagttgataacccttttgcctggagaagga
 L  N  R  S  S  S  E  C  S  T  V  D  N  P  L  P  G  E  G gaagaagcagaggctgaacctatgaattccgatgagccagaggcctgtttcacagatggt
 E  E  A  E  A  E  P  M  N  S  D  E  P  E  A  C  F  T  D  G tgtgtatggaggttctcatgctgccaagttaacatagagtcagggaaaggaaaaatctgg
 C  V  W  R  P  S  C  C  Q  V  N  I  E  S  G  K  G  K  I  W tggaacatcaggaaaacctgctacaagattgttaacacagttggtttgaaagcttcatt
 W  N  I  R  K  T  C  Y  K  I  V  E  H  S  W  F  E  S  F  I gtcctcatgatcctgctcagcagtggtgcccctggcttttgaagatatttatattgaaagg
 V  L  M  I  L  L  S  S  G  A  L  A  F  E  D  I  Y  I  E  R aaaaagaccattaagattatcctggagtatgcagacaagatcttcacttacatcttcatt
 K  K  T  I  K  I  I  L  E  Y  A  D  K  I  F  T  Y  I  F  I ctggaaatgcttctaaaatggatagcatatggttataaaacatatttcaccaatgcctgg
 L  E  M  L  L  K  W  I  A  Y  G  Y  K  T  Y  F  T  N  A  W tgttggctggatttcctaattgttgatgtttctttggttactttagtggcaaacactctt
 C  W  L  D  F  L  I  V  D  V  S  L  V  T  L  V  A  N  T  L ggctactcagatcttggccccattaaatcccttcggacactgagagctttaagacctcta
 G  Y  S  D  L  G  P  I  K  S  L  R  T  L  R  A  L  R  P  L agagccttatctagatttgaaggaatgagggtcgttgtgaatgcactcataggagcaatt
 R  A  L  S  R  F  E  G  M  R  V  V  V  N  A  L  I  G  A  I ccttccatcatgaatgtgctacttgtgtgtcttatattctggctgatattcagcatcatg
 P  S  I  M  N  V  L  L  V  C  L  I  F  W  L  I  F  S  I  M ggagtaaatttgtttgctggcaagttctatgagtgtattaacaccacagatgggtcacgg
 G  V  N  L  F  A  G  K  F  Y  E  C  I  N  T  T  D  G  S  R tttcctgcaagtcaagttccaaatcgttccgaatgttttgcccttatgaatgttagtcaa
 F  P  A  S  Q  V  P  N  R  S  E  C  F  A  L  M  N  V  S  Q aatgtgcgatggaaaaacctgaaagtgaactttgataatgtcggacttggttacctatct
 N  V  R  W  K  N  L  K  V  N  F  D  N  V  G  L  G  Y  L  S ctgcttcaagttgcaacttttaagggatggacgattattatgtatgcagcagtggattct
 L  L  Q  V  A  T  F  K  G  W  T  I  I  M  Y  A  A  V  D  S gttaatgtagacaagcagcccaaatatgaatatagcctctacatgtatatttattttgtc
 V  N  V  D  K  Q  P  K  Y  E  Y  S  L  Y  M  Y  I  Y  F  V gtctttatcatctttgggtcattcttcactttgaacttgttcattggtgtcatcatagat
 V  F  I  I  F  G  S  F  F  T  L  N  L  F  I  G  V  I  I  D aatttcaaccaacagaaaaagaagcttggaggtcaagacatctttatgacagaagaacag
 N  F  N  Q  Q  K  K  K  L  G  G  Q  D  I  F  M  T  E  E  Q aagaaatactataatgcaatgaaaaagctggggtccaagaagccacaaaagccaattcct
 K  K  Y  Y  N  A  M  K  K  L  G  S  K  K  P  Q  K  P  I  P cgaccagggaacaaaatccaaggatgtatatttgacctagtgacaaatcaagcctttgat
 R  P  G  N  K  I  Q  G  C  I  F  D  L  V  T  N  Q  A  F  D attagtatcatggttcttatctgtctcaacatggtaaccatgatggtagaaaaggagggt
 I  S  I  M  V  L  I  C  L  N  M  V  T  M  M  V  E  K  E  G caaagtcaacatatgactgaagttttatattggataaatgtggtttttataatccttttc
 Q  S  Q  H  M  T  E  V  L  Y  W  I  N  V  V  F  I  I  L  F actggagaatgtgtgctaaaactgatctccctcagacactactacttcactgtaggatgg
 T  G  E  C  V  L  K  L  I  S  L  R  H  Y  Y  F  T  V  G  W aatattttgattttgtggttgtgattatctccattgtaggtatgtttctagctgatttg
 N  I  F  D  F  V  V  V  I  I  S  I  V  G  M  F  L  A  D  L attgaaacgtatttgtgtcccctaccctgttccgagtgatccgtcttgccaggattggc
 I  E  T  Y  P  V  S  P  T  L  F  R  V  I  R  L  A  R  I  G
```

```
cgaatcctacgtctagtcaaaggagcaaaggggatccgcacgctgctctttgctttgatg
 R   I   L   R   L   V   K   G   A   K   G   I   R   T   L   L   F   A   L   M atgtcccttcctgcgttgtttaacatcggcctcctgctcttcctggtcatgttcatctac
 M   S   L   P   A   L   F   N   I   G   L   L   L   F   L   V   M   F   I   Y gccatctttggaatgtccaactttgcctatgttaaaaaggaagatggaattaatgacatg
 A   I   F   G   M   S   N   F   A   Y   V   K   K   E   D   G   I   N   D   M ttcaattttgagacctttggcaacagtatgatttgcctgttccaaattacaacctctgct
 F   N   F   E   T   P   G   N   S   M   I   C̲   L   F   Q̲   I   T   T   S   A ggctgggatggattgctagcacctattcttaacagtaagccacccgactgtgacccaaaa
 G   W̲   D   G   L   L   A   P   I   L   N   S   K   P   P   D   C̲   D   P   K aaagttcatcctggaagttcagttgaaggagactgtggtaacccatctgttggaatattc
 K   V   H   P   G   S   S   V   E   G   D   C̲   G   N   P   S   V   G   I   F tactttgttagttatatcatcatatccttcctggttgtggtgaacatgtacattgcagtc
 Y   F   V   S   Y   I   I   I   S   F   L   V   V   V   N   M   Y   I   A   V atactggagaattttagtgttgccactgaagaaagtactgaacctctgagtgaggatgac
 I   L   E   N   P   S   V   A   T   E   E   S   T   E   P   L   S   E   D   D tttgagatgttctatgaggtttgggagaagtttgatcccgatgcgacccagtttatagag
 F   E   M   F   Y   E   V   W̲   E   K   F   D   P   D   A   T   Q̲   F   I   E ttctctaaactctctgattttgcagctgccctggatcctcctcttctcatagcaaaaccc
 F   S   K   L   S   D   F   A   A   A   L   D   P   P   L   L   I   A   K   P aacaaagtccagctcattgccatggatctgcccatggttagtggtgaccggatccattgt
 N   K   V   Q̲   L   I   A   M   D   L   P   M   V   S   G   D   R   I   H   C̲ cttgacatcttatttgcttttacaaagcgtgttttgggtgagagtggggagatggattct
 L   D   I   L   F   A   F   T   K   R   V   L   G   E   S   G   E   M   D   S cttcgttcacagatggaagaaaggttcatgtctgcaaatccttccaaagtgtcctatgaa
 L   R   S   Q̲   M   E   E   R   F   M   S   A   N   P   S   K   V   S   Y   E cccatcacaaccacactaaaacggaaacaagaggatgtgtctgctactgtcattcagcgt
 P   I   T   T   T   L   K   R   K   Q̲   E   D   V   S   A   T   V   I   Q̲   R gcttatagacgttaccgcttaaggcaaaatgtcaaaaatatatcaagtatatacataaaa
 A   Y   R   R   Y   R   L   R   Q̲   N   V   K   N   I   S   S   I   Y   I   K gatggagacagagatgatgatttactcaataaaaaagatatggcttttgataatgttaat
 D   G   D   R   D   D   D   L   L   N   K   K   D   M   A   F   D   N   V   N gagaactcaagtccagaaaaaacagatgccacttcatccaccacctctccaccttcatat
 E   N   S   S   P   E   K   T   D   A   T   S   S   T   T   S   P   P   S   Y gatagtgtaacaaagccagacaaagagaaatatgaacaagacagaacagaaaaggaagac
 D   S   V   T   K   P   D   K   E   K   Y   E   Q̲   D   R   T   E   K   E   D aaagggaaagacagcaaggaaagcaaaaaatagagcttcattttgatatattgtttaca (SEQ ID NO: 2433)
 K   G   K   D   S   K   E   S   K   K   -                                       (SEQ ID NO: 2434)
```

Human SCN9A gene sequence. Includes open reading frames (capitalized) and introns (lowercase, abridged). Underlined bases are predicted to disrupt the splicing of the RNA transcript, leading to diminished expression of functional protein. The start codon is also highlighted in bold.

CGGGGCTGCTACCTCCACGGGCGCGCCCTGGCAGGAGGGGCGCAGTCTGC

TTGCAGGCGGTCGCCAGCGCTCCAGCGGCGGCTGTCGGCTTTCCAATTCC

GCCAGCTCGGCTGAGGCTGGGCTAGCCTGGGTGCCAGTGGCTGCTAGCGG

CAGGCGTCCCCTGAGCAACAGGAGCCCAGAGAAAAAGAAGCAGCCCTGAG

-continued

AGAGCGCCGGGGAAGGAGAGGCCCGCGCCCTCTCCTGGAGCCAGATTCTG

CAGGTGCACTGGGTGGGGATGATCGGCGGGCTAGGTTGCAAgtaagtgcc ttttcttttgctgcttctgtggggaggggaggagaagccctcggtctttc ...intron 1...

tttatgttgttattattagtttttaatgggcctttcttggcaggcaaata gttaagtctttatttctttgtttccatccagGCCTCTTATGTGAGGAGCT

GAAGAGGAATTAAAATATACAGGATGAAAAGATGGCAATGTTGCCTCCCC

CAGGACCTCAGAGCTTTGTCCATTTCACAAAACAGTCTCTTGCCCTCATT

GAACAACGCATTGCTGAAAGAAAATCAAAGGAACCCAAAGAAGAAAAGAA

AGATGATGATGAAGAAGCCCCAAAGCCAAGCAGTGACTTGGAAGCTGGCA

AACAGCTGCCCTTCATCTATGGGACATTCCTCCCGGCATGGTGTCAGAG

CCCCTGGAGGACTTGGACCCCTACTATGCAGACAAAAAGgtgagtttatt ttgacttcagtggtcagtttctgttggcttccttctgtataaaaattatt ...intron 2...

atattgatgtgaaaaattgatattttggattctcaatttcatcctttctt tttcctcctgcagACTTTCATAGTATTGAACAAAGGGAAAACAATCTTCC

GTTTCAATGCCACACCTGCTTTATATATGCTTTCTCCTTTCAGTCCTCTA

AGAAGAATATCTATTAAGATTTTAGTACACTCatatccttttaaaaatga ttacatccagtggcactttatggtgtaattttttgctattttattcaaata ...intron 3...

cccactgtcgtctcttttgttccttgattctaagctacCTTATTCAGCAT

GCTCATCATGTGCACTATTCTGACAAACTGCATATTTATGACCATGAATA

ACCCACCGGACTGGACCAAAAATGTCGAgtaagtgggtataagtacattt taatatagttttggtattatcatttcatcctttccttttcctgccaggaa ...intron 4...

ttataaagatttacatggtggttgtattcttttcacatctagtatcccaa tggaatcttgtgtttagGTACACTTTTACTGGAATATATACTTTTGAATC

ACTTGTAAAAATCCTTGCAAGAGGCTTCTGTGTAGGAGAATTCACTTTTC

TTCGTGACCCGTGGAACTGGCTGGATTTTGTCGTCATTGTTTTTGCgtaa gtactttcagcttttttgaaacggcaaatttatgaaaatctcaggcagcac ...intron 5...

tcaggtaagtatcatagactctatctaaattctgaataattctgatttaa ttctacagGTATTTAACAGAATTTGTAAACCTAGGCAATGTTTCAGCTCT

TCGAACTTTCAGAGTATTGAGAGCTTTGAAAACTATTTCTGTAATCCCAG gtaagaagtaattggtgtgaagcattaggccactcataactccaactatt

...intron 6...

atgtcattacaaacactttttctcccatttttcagGCCTGAAGACAATTG

TAGGGGCTTTGATCCAGTCAGTGAAGAAGCTTTCTGATGTCATGATCCTG

ACTGTGTTCTGTCTGAGTGTGTTTGCACTAATTGGACTACAGCTGTTCAT

GGGAAACCTGAAGCATAAATGTTTTCGAAATTCACTTGAAAATAATGAAA

```
CATTAGAAAGCATAATGAATACCCTAGAGAGTGAAGAAGACTTTAGAAgt aagaatgtccttgcatttgttattaggttgaaataatgctaaaaacattg ...intron 7...

attaatttacctcctttatcacaatcacagattaaagtctgtgatgttat aactgttcaaattcttcttcaacagAATATTTTTATTACTTGGAAGGATC CAAAGATGCTCTCCTTTGTGGTTTCAGCACAGATTCAGggtatgtaatat ttgttttcttttagtctaaaggctgaaagagaaggaaaagaatgttcag ...intron 8...

cagtaaggctatttagcttgtgtcctgaagacactctcacctataatgtt ctttctcgtgtgtagTCAGTGTCCAGAGGGGTACACCTGTGTGAAAATTG

GCAGAAACCCTGATTATGGCTACACGAGCTTTGACACTTTCAGCTGGGCC

TTCTTAGCCTTGTTTAGGCTAATGACCCAAGATTACTGGGAAAACCTTTA

CCAACAGgtgagtaccaagagaaacatgcattgtattttttgaatggcata

...intron 9...

tgtacctggtgtatgttaagagcctgtattaggaggttttttatttattt aaaaacttttttattgttcaaatgacaatttccattttttccctagACGCTG

CGTGCTGCTGGCAAAACCTACATGATCTTCTTTGTCGTAGTGATTTTCCT

GGGCTCCTTTTATCTAATAAACTTGATCCTGGCTGTGGTTGCCATGGCAT

ATGAAGAACAGAACCAGGCAAACATTGAAGAAGCTAAACAGAAAGAATTA

GAATTTCAACAGATGTTAGACCGTCTTAAAAAAGAGCAAGAAGAAGCTGA

Ggtactgttatttgatttaaaattcttcctagaggtagaaatgcaaacgg

...intron 10...

tgtcctagggtttcctaggatttggaaatgactcatttaagtgttaacgt cttggcccaaccagGCAATTGCAGCGGCAGCGGCTGAATATACAAGTATT

AGGAGAAGCAGAATTATGGGCCTCTCAGAGAGTTCTTCTGAAACATCCAA

ACTGAGCTCTAAAAGTGCTAAAGAAAGAAGAAACAGAAGAAAGAAAAAGA

ATCAAAAGAAGCTCTCCAGTGGAGAGGAAAAGGGAGATGCTGAGAAATTG

TCGAAATCAGAATCAGAGGACAGCATCAGAAGAAAAAGTTTCCACCTTGG

TGTCGAAGGGCATAGGCGAGCACATGAAAAGAGGTTGTCTACCCCCAATC

AGgtaccacccaaattgctaaatgtgtatcacccgaggcagaatgctaga

...intron 11...

atatgaagtgtacttctatcagtaggtgcttcagcaaccacgttttttt aattttttctgcagTCACCACTCAGCATTCGTGGCTCCTTGTTTTCTGCAA

GGCGAAGCAGCAGAACAAGTCTTTTTAGTTTCAAAGGCAGAGGAAGAGAT

ATAGGATCTGAGACTGAATTTGCCGATGATGAGCACAGCATTTTTGGAGA

CAATGAGAGCAGAAGGGGCTCACTGTTTGTGCCCCACAGACCCCAGGAGC

GACGCAGCAGTAACATCAGCCAAGCCAGTAGGTCCCCACCAATGCTGCCG

GTGAACGGGAAAATGCACAGTGCTGTGGACTGCAACGGTGTGGTCTCCCT

GGTTGATGGACGCTCAGCCCTCATGCTCCCCAATGGACAGCTTCTGCCAG

AGgtgataatagataaggcaacttctgatgacagcgtaaggacgttttac ctatataagcaagatttatcttatacctacaatttattaggattctgtt
```

...intron 12...

cttaagacattaattgattttttttttagGGCACGACCAATCAAATACAC
AAGAAAAGGCGTTGTAGTTCCTATCTCCTTTCAGAGGATATGCTGAATGA
TCCCAACCTCAGACAGAGAGCAATGAGTAGAGCAAGCATATTAACAAACA
CTGTGGAAGgtatgtaataatcttcttttactgtacagattcttaaataa ...intron 13...

agacaaatggctgactccatgttctctgcttttttctcccagAACTTGAA
GAGTCCAGACAAAAATGTCCACCTTGGTGGTACAGATTTGCACACAAATT
CTTGATCTGGAATTGCTCTCCATATTGGATAAAATTCAAAAAGTGTATCT
ATTTTATTGTAATGGATCCTTTTGTAGATCTTGCAATTACCATTTGCATA
GTTTTAAACACATTATTTATGGCTATGGAACACCACCCAATGACTGAGGA
ATTCAAAAATGTACTTGCTATAGGAAATTTGgtaagtctcttattgtgtg
ttatgtactcatagtttctcttttt agttgtcatcattgtcatttcatat ...intron 14...

aacagtgattattatcattgtgttgatttcctgttttctaatattaacag
aaaaacattattttttctcacttagGTCTTTACTGGAATCTTTGCAGCTGA
AATGGTATTAAAACTGATTGCCATGGATCCATATGAGTATTTCCAAGTAG
GCTGGAATATTTTTGACAGCCTTATTGTGACTTTAAGTTTAGTGGAGCTC
TTTCTAGCAGATGTGGAAGGATTGTCAGTTCTGCGATCATTCAGACTGgt
aaacataaactaaggttgccattatattctataataaaggggtatttctt ...intron 15...

gaaaagattttcatagtgattaacattaaactttatatttgcttttagCT
CCGAGTCTTCAAGTTGGCAAAATCCTGGCCAACATTGAACATGCTGATTA
AGATCATTGGTAACTCAGTAGGGGCTCTAGGTAACCTCACCTTAGTGTTG
GCCATCATCGTCTTCATTTTTGCTGTGGTCGGCATGCAGCTCTTTGGTAA
GAGCTACAAAGAATGTGTCTGCAAGATCAATGATGACTGTACGCTCCCAC
GGTGGCACATGAACGACTTCTTCCACTCCTTCCTGATTGTGTTCCGCGTG
CTGTGTGGAGAGTGGATAGAGACCATGTGGGACTGTATGGAGGTCGCTGG
TCAAGCTATGTGCCTTATTGTTTACATGATGGTCATGGTCATTGGAAACC
TGGTGgtatgtaaccagatgttcatgcatttttaatttctctgtggaaatt ...intron 16...

attttatttttt atatttcctgtctccctatttctctacccctctcccc
accctgatattagGTCCTAAACCTATTTCTGGCCTTATTATTGAGCTCATT
TAGTTCAGACAATCTTACAGCAATTGAAGAAGACCCTGATGCAAACAACC
TCCAGATTGCAGTGACTAGAATTAAAAAGGGAATAAATTATGTGAAACAA
ACCTTACGTGAATTTATTCTAAAAGCATTTTCCAAAAAGCCAAAGATTTC
CAGGGAGATAAGACAAGCAGAAGATCTGAATACTAAGAAGGAAAACTATA
TTTCTAACCATACACTTGCTGAAATGAGCAAAGGTCACAATTTCCTCAAG
GAAAAGATAAAATCAGTGGTTTTGGAAGCAGCGTGGACAAACACTTGAT
GGAAGACAGTGATGGTCAATCATTTATTCACAATCCCAGCCTCACAGTGA -continued

```
CAGTGCCAATTGCACCTGGGGAATCCGATTTGGAAAATATGAATGCTGAG

GAACTTAGCAGTGATTCGGATAGTGAATACAGCAAAGTGgtaagaatgct tcatatactttgtgtttcatattaacaattagtatgaaatgaatgaaaat ...intron 17...

tttgaatgaactctaaatgaactacctggtggggtggtgaattcctttct ag AGATTAAACCGGTCAAGCTCCTCAGAGTGCAGCACAGTTGATAACCCT

TTGCCTGGAGAAGGAGAAGAAGCAGAGGCTGAACCTATGAATTCCGATGA

GCCAGAGGCCTGTTTCACAGATGgtaagacaaaaattgagaccttggtta gcattccttaattagtgttctggggtttgtcttaacgcctaatacttacc ...intron 18...

caagatttaacatgcatgtctttcttgtcagGTTGTGTATGGAGGTTCTC

ATGCTGCCAAGTTAACATAGAGTCAGGGAAAGGAAAAATCTGGTGGAACA

TCAGGAAAACCTGCTACAAGATTGTTGAACACAGTTGGTTTGAAAGCTTC

ATTGTCCTCATGATCCTGCTCAGCAGTGGTGCCCTGgtaaatgatctgac acctaagtcaatatattgattaagtcaatattctttaaaatgagctaaaa ...intron 19...

tcctgttttttttaaatgaatcatgaagcttaagttgtgcatgattgaaa cttgaatattatttccacagGCTTTTGAAGATATTTATATTGAAAGGAAA

AAGACCATTAAGATTATCCTGGAGTATGCAGACAAGATCTTCACTTACAT

CTTCATTCTGGAAATGCTTCTAAAATGGATAGCATATGGTTATAAAACAT

ATTTCACCAATGCCTGGTGTTGGCTGGATTTCCTAATTGTTGATgtaggt acttttgagtacattttaaaagaggatttattcttactgtgtgttgtgaa ...intron 20...

agtttcagaattgacttttcctttatgcttcatcattttattgacaca attaatgaaaatgttatttttatagGTTTCTTTGGTTACTTTAGTGGCAA

ACACTCTTGGCTACTCAGATCTTGGCCCCATTAAATCCCTTCGGACACTG

AGAGCTTTAAGACCTCTAAGAGCCTTATCTAGATTTGAAGGAATGAGGgt aagaaaatactaaactttataatgttcttatttttaatggggtttaaaa ...intron 21...

ctttcatgttgcctatttaacatcttactaatcctaatcatgcttttctt tcttttgaatactagGTCGTTGTGAATGCACTCATAGGAGCAATTCCTTC

CATCATGAATGTGCTACTTGTGTGTCTTATATTCTGGCTGATATTCAGCA

TCATGGGAGTAAATTTGTTTGCTGGCAAGTTCTATGAGTGTATTAACACC

ACAGATGGGTCACGGTTTCCTGCAAGTCAAGTTCCAAATCGTTCCGAATG

TTTTGCCCTTATGAATGTTAGTCAAAATGTGCGATGGAAAAACCTGAAAG

TGAACTTTGATAATGTCGGACTTGGTTACCTATCTCTGCTTCAAGTTgta agtgtcccatttcatgagtgcttggtattttaatagatattggacgaagg ...intron 22...

tctgtttatggctatttagaatatgagcttaacattcaaattctattaa tgttattcttaaagGCAACTTTTAAGGGATGGACGATTATTATGTATGCA GCAGTGGATTCTGTTAATgtaagtattgattatcttagcactaaacttta
```

```
tttttaaaagcttcttagtttatttcagtgatttccaaactataacttca

...intron 23...

tccatataatgctaactttttgtaaattttatagGTAGACAAGCAGCCCAA

ATATGAATATAGCCTCACATGTATATTTATTTTGTCGTCTTTATCATCT

TTGGGTCATTCTTCACTTTGAACTTGTTCATTGGTGTCATCATAGATAAT

TTCAACCAACAGAAAAAGAAGataagtatttcaaatattttcattgtaa

...intron 24...

tttagtaatctatagaaagatgtagacaatgattctggttttaactacat ttattttttgtttgtttctttacCTTGGAGGTCAAGACATCTTTATGACA

GAAGAACAGAAGAAATACTATAATGCAATGAAAAAGCTGGGGTCCAAGAA

GCCACAAAAGCCAATTCCTCGACCAGGGgtaaaaaaatatatatatcttt agcatatagattttcaaattatttctaattcattttaatgcacatcttt ...intron 25...

aatttctggataatacttgaaaagtttactctgcattcgatattattctt atttctttgcagAACAAAATCCAAGGATGTATATTTGACCTAGTGACAAA

TCAAGCCTTTGATATTAGTATCATGGTTCTTATCTGTCTCAACATGGTAA

CCATGATGGTAGAAAAGGAGGGTCAAAGTCAACATATGACTGAAGTTTTA

TATTGGATAAATGTGGTTTTTATAATCCTTTTCACTGGAGAATGTGTGCT

AAAACTGATCTCCCTCAGACACTACTACTTCACTGTAGGATGGAATATTT

TTGATTTTGTGGTTGTGATTATCTCCATTGTAGgtaagaatattatttt tcagattttatttttttgagtaaagctaaacttcacttatgctcaaggaag ...intron 26...

ctgtttagagtcatcatttcaggtagcatacatcttttaaatattttattt ctattattttcctccacatacagGTATGTTTCTAGCTGATTTGATTGAAA

CGTATTTTGTGTCCCCTACCCTGTTCCGAGTGATCCGTCTTGCCAGGATT

GGCCGAATCCTACGTCTAGTCAAAGGAGCAAAGGGGATCCGCACGCTGCT

CTTTGCTTTGATGATGTCCCTTCCTGCGTTGTTTAACATCGGCCTCCTGC

TCTTCCTGGTCATGTTCATCTACGCCATCTTTGGAATGTCCAACTTTGCC

TATGTTAAAAAGGAAGATGGAATTAATGACATGTTCAATTTTGAGACCTT

TGGCAACAGTATGATTTGCCTGTTCCAAATTACAACCTCTGCTGGCTGGG

ATGGATTGCTAGCACCTATTCTTAACAGTAAGCCACCCGACTGTGACCCA

AAAAAAGTTCATCCTGGAAGTTCAGTTGAAGGAGACTGTGGTAACCCATC

TGTTGGAATATTCTACTTTGTTAGTTATATCATCATATCCTTCCTGGTTG

TGGTGAACATGTACATTGCAGTCATACTGGAGAATTTTAGTGTTGCCACT

GAAGAAAGTACTGAACCTCTGAGTGAGGATGACTTTGAGATGTTCTATGA

GGTTTGGGAGAAGTTTGATCCCGATGCGACCCAGTTTATAGAGTTCTCTA

AACTCTCTGATTTTGCAGCTGCCCTGGATCCTCCTCTTCTCATAGCAAAA

CCCAACAAAGTCCAGCTCATTGCCATGGATCTGCCCATGGTTAGTGGTGA

CCGGATCCATTGTCTTGACATCTTATTTGCTTTTACAAAGCGTGTTTTGG

GTGAGAGTGGGGAGATGGATTCTCTTCGTTCACAGATGGAAGAAAGGTTC
```

(SEQ ID NO: 2435)

-continued

```
ATGTCTGCAAATCCTTCCAAAGTGTCCTATGAACCCATCACAACCACACT

AAAACGGAAACAAGAGGATGTGTCTGCTACTGTCATTCAGCGTGCTTATA

GACGTTACCGCTTAAGGCAAAATGTCAAAATATATCAAGTATATACATA

AAAGATGGAGACAGAGATGATGATTTACTCAATAAAAAAGATATGGCTTT

TGATAATGTTAATGAGAACTCAAGTCCAGAAAAAACAGATGCCACTTCAT

CCACCACCTCTCCACCTTCATATGATAGTGTAACAAAGCCAGACAAAGAG

AAATATGAACAAGACAGAACAGAAAAGGAAGACAAAGGGAAAGACAGCAA

GGAAAGCAAAAATAGAGCTTCATTTTTGATATATTGTTTACAGCCTGTG

AAAGTGATTTATTTGTGTTAATAAAACTCTTTTGAGGAAGTCTATGCCAA

AATCCTTTTTATCAAAATATTCTCGAAGGCAGTGCAGTCACTAACTCTGA

TTTCCTAAGAAAGGTGGGCAGCATTAGCAGATGGTTATTTTTGCACTGAT

GATTCTTTAAGAATCGTAAGAGAACTCTGTAGGAATTATTGATTATAGCA

TACAAAAGTGATTCAGTTTTTTGGTTTTTAATAAATCAGAAGACCATGTA

GAAAACTTTTACATCTGCCTTGTCATCTTTTCACAGGATTGTAATTAGTC

TTGTTTCCCATGTAAATAAACAACACACGCATACAGAAAAATCTATTATT

TATCTATTATTTGGAAATCAACAAAAGTATTTGCCTTGGCTTTGCAATGA

AATGCTTGATAGAAGTAATGGACATTAGTTATGAATGTTTAGTTAAAATG

CATTATTAGGGAGCTTGACTTTTTATCAATGTACAGAGGTTATTCTATAT

TTTGAGGTGCTTAAATTTATTCTACATTGCATCAGAACCAATTTATATGT

GCCTATAAAATGCCATGGGATTAAAAATATATGTAGGCTATTCATTTCTA

CAAATGTTTTTCATTCATCTTGACTCACATGCCAACAAGGATAAGACTTA

CCTTTAGAGTATTGTGTTTCATAGCCTTTCTTCTTTCATATCCCTTTTTG

TTCATAGAATAACCACAGAACTTGAAAAATTATTCTAAGTACATATTACA

CTCCTCAAAAAAACAAAGATAACTGAGAAAAAAGTTATTGACAGAAGTT

CTATTTGCTATTATTTACATAGCCTAACATTTGACTGTGCTGCCCAAAAT

ACTGATAATAGTCTCTTAAACTCTTTTGTCAAATTTTCCTGCTTTCTTAT

GCAGTATTGTTTAGTCATCCTTTCGCTGTAAGCAAAGTTGATGAAATCCT

TCCTGATATGCAGTTAGTTGTTTGACCACGGTACATACTTGAGCAGATAA

TAACTTGGGCACAGTATTTATTGCATCACTTGTATACAATCCCGTGTTTG

GCAAGCTTTCAAATCATGTAATATGACAGACTTTACACAGATATGTGTTT

AGTATGAATAAAAAAGCATTGAAATAGGGATTCTTGCCAACTTGCTCTCT

TGCCACCAACTTACTTTCCTAAATTATGGAAGTAATCTTTTTTGGATATA

CTTCAATGTATACAATGAGGAAGATGTCACCTTCTCCTTAAAATTCTATG

ATGTGAAATATATTTTGCCTCAATCAACACAGTACCATGGGCTTCTAATT

TATCAAGCACATATTCATTTTGCATTAGCTGTAGACATCTAGTTTTTTGA

AAACACCTATTAATAGTAATTTGAAAAGAAATAACCATAATGCTTTTTTT

CGTGAGTTTATTTCAGGAATATGAGATCTTTCTTCTATAAAGTTATTCAT

GCACAGGCAAAAATTGAGCTACACAGGTAGAATGTAGTTTTACTTAGAAG

ATTTTTGTGGGAGGTTTTGAAGCAAATATATAAAACAACTTTCACTAATT

TGCTTTCCATATTTAAAAAATAATAAATTACATTTATATAATAAATGTTT
```

-continued

```
AAAGCACATATTTTTTGTTGTTCTGGCAATTTAAAAAGAAAGAGGATTTA

AACGTACCTATAGAAACAAAGATTTATGGTTAAAGAATGAGATCAGAAGT

CTAGAATGTTTTTAAATTGTGATATATTTTACAACATCCGTTATTACTTT

GAGACATTTGTCCTAATCTACGTATAAAACTCAATCTAGGGCTAAAGATT

CTTTATACCATCTTAGGTTCATTCATCTTAGGCTATTTGAACCACTTTTT

AATTTAATATGAAAGACACCATGCAGTGTTTTCCGAGACTACATAGATCA

TTTTATCACATACCTACCAAGCCTGTTGGAAATAGGTTTTGATAATTTAA

GTAGGGACCTATACAAAATATATTACATTTATCAGATTTTTAAATACATT

CAATTAAGAATTTAACATCACCTTAAATTTGAATTCAATCTACCGTTATT

TCAAACTCACAAATATAACTGCATTATGAATACTTACATAATGTAGTAAG

ACAAGATGTTTGACAGGTTCGTGTGTAATTTTCTATTAATGTTTTTACAT

TGCCTTGTTTTTATGTAAAATAAAAAATATGGGCAACTGGTTTGTTAACA

ACACAATTTCTTCTTAGCATTTCAAAAATATATATAAAGTTGTTCTTTTT

CCTATTTCATGAACTATGTTTTTTTTAAAATAACATGGTTAAGTTTTAT

ATATATTTACGTTTGTTTCAGGAATGTCTACTTGTGACTTTTTATCAATT

AAAAATAATATTTGGAAGAAAGAGCTTATTAAGTATAAGCTTGAAGTAAA

ATTAGACCTCTCTTTCCATGTAGATTACTGTTTGTACTGATGGTTTCACC

CTTCAGAAGGCACTGTCATATTAATATTTAAATTTTATAATCGCTGAACT

TATTACACCCAACAATACAGAAAGGCAGTTACACTGAAGAACTTAACTTA

GAATAAAATGGAAGCAAACAGGTTTTCTAAAAACTTTTTTAAGTGACCAG

GTCTCGCTCTGTCACCCAGGCTAGAGTGCAATGGCATGATCATAGCTCTC

TGCAGCCTCAACTCTGGGCTCAAGCAACCCTCCTGCCTCAGCCTCCCAAG

TAGCTAAGACTACAGGTACATGCCACCATGCCTGGCTAATATTTAAATTT

TTGTAGATAAGGGGTCTTGCTATGTTGCCCAGGCTAGTCTCAAACTCCTG

GCTTCAAGTGTTCCTACTGTCATGACCTGCCAACATGCTGGGGTTACAGG

CATGAGCCACCATGCCCCAAACAGGTTTGAACACAAATCTTTCGGATGAA

AATTAGAGAACCTAATTTTAGCTTTTTGATAGTTACCTAGTTTGCAAAAG

ATTTGGGTGACTTGTGAGCTGTTTTTAAATGCTGATTGTTGAACATCACA

ACCCAAAATACTTAGCATGATTTTATAGAGTTTTGATAGCTTTATTAAAA

AGAGTGAAAATAAAATGCATATGTAAATAAAGCAGTTCTAAATAGCTATT

TCAGAGAAATGTTAATAGAAGTGCTGAAAGAAGGGCCAACTAAATTAGGA

TGGCCAGGGAATTGGCCTGGGTTTAGGACCTATGTATGAAGGCCACCAAT

TTTTTAAAAATATCTGTGGTTTATTATGTTATTATCTTCTTGAGGAAAAC

AATCAAGAATTGCTTCATGAAAATAAATAAATAGCCATGAATATCATAAA

GCTGTTTACATAGGATTCTTTACAAATTTCATAGATCTATGAATGCTCAA

AATGTTTGAGTTTGCCATAAATTATATTGTAGTTATATTGTAGTTATACT

TGAGACTGACACATTGTAATATAATCTAAGAATAAAAGTTATACAAAATA

A
```

-continued

SCN10A (Uniprot #: Q9Y5Y9)
Synonyms: NaV1.8, PN3, hPN3
(SEQ ID NO: 2436)
MEFPIGSLETNNFRRFTPESLVEIEKQIAAKQGTKKAREKHREQKDQEEKPRPQLDLKACNQLPKFYGE

LPAELIGEPLEDLDPFYSTHRTFMVLNKGRTISRFSATRALWLFSPFNLIRRTAIKVSVHSWFSLFITVTIL

VNCVCMTRTDLPEKIEYVFTVIYTFEALIKILARGFCLNEFTYLRDPWNWLDFSVITLAYVGTAIDLRGI

SGLRTFRVLRALKTVSVIPGLKVIVGALIHSVKKLADVTILTIFCLSVFALVGLQLFKGNLKNKCVKND

MAVNETTNYSSHRKPDIYINKRGTSDPLLCGNGSDSGHCPDGYICLKTSDNPDFNYTSFDSFAWAFLSL

FRLMTQDSWERLYQQTLRTSGKIYMIFFVLVIFLGSFYLVNLILAVVTMAYEEQNQATTDEIEAKEKKF

QEALEMLRKEQEVLAALGIDTTSLHSHNGSPLTSKNASERRHRIKPRVSEGSTEDNKSPRSDPYNQRRM

SFLGLASGKRRASHGSVFHFRSPGRDISLPEGVTDDGVFPGDHESHRGSLLLGGGAGQQGPLPRSPLPQP

SNPDSRHGEDEHQPPPTSELAPGAVDVSAFDAGQKKTFLSAEYLDEPFRAQRAMSVVSIITSVLEELEES

EQKCPPCLTSLSQKYLIWDCCPMWVKLKTILFGLVTDPFAELTITLCIVVNTIFMAMEHHGMSPTFEAM

LQIGNIVFTIFFTAEMVFKIIAFDPYYYFQKKWNIFDCIIVTVSLLELGVAKKGSLSVLRSFRLLRVFKLA

KSWPTLNTLIKIIGNSVGALGNLTIILAIIVFVFALVGKQLLGENYRNNRKNISAPHEDWPRWHMHDFFH

SFLIVFRILCGEWIENMWACMEVGQKSICLILFLTVMVLGNLVVLNLFIALLLNSFSADNLTAPEDDGEV

NNLQVALARIQVFGHRTKQALCSFFSRSCPFPQPKAEPELVVKLPLSSSKAENHIAANTARGSSGGLQAP

RGPRDEHSDFIANPTVWVSVPIAEGESDLDDLEDDGGEDAQSFQQEVIPKGQQEQLQQVERCGDHLTP

RSPGTGTSSEDLAPSLGETWKDESVPQVPAEGVDDTSSSEGSTVDCLDPEEILRKIPELADDLEEPDDCF

TEGCIRHCPCCKLDTTKSPWDVGWQVRKTCYRIVEHSWFESFIIFMILLSSGSLAFEDYYLDQKPTVKA

LLEYTDRVFTFIFVFEMLLKWVAYGFKKYFTNAWCWLDFLIVNISLISLTAKILEYSEVAPIKALRTLRA

LRPLRALSRFEGMRVVVDALVGAIPSIMNVLLVCLIFWLIFSIMGVNLFAGKFWRCINYTDGEFSLVPLS

IVNNKSDCKIQNSTGSFFWVNVKVNFDNVAMGYLALLQVATFKGWMDIMYAAVDSREVNMQPKWE

DNVYMYLYFVIFIIFGGFFTLNLFVGVIIDNFNQQKKKLGGQDIFMTEEQKKYYNAMKKLGSKKPQKPI

PRPLNKFQGFVFDIVTRQAFDITIMVLICLNMITMMVETDDQSEEKTKILGKINQFFVAVFTGECVMKM

FALRQYYFTNGWNVFDFIVVVLSIASLIFSAILKSLQSYFSPTLFRVIRLARIGRILRLIRAAKGIRTLLFAL

MMSLPALFNIGLLLFLVMFIYSIFGMSSFPHVRWEAGIDDMFNFQTFANSMLCLFQITTSAGWDGLLSPI

LNTGPPYCDPNLPNSNGTRGDCGSPAVGIIFFTTYIIISFLIMVNMYIAVILENFNVATEESTEPLSEDDFD

MFYETWEKFDPEATQFITFSALSDFADTLSGPLRIPKPNRNILIQMDLPLVPGDKIHCLDILFAFTKNVLG

ESGELDSLKANMEEKFMATNLSKSSYEPIATTLRWKQEDISATVIQKAYRSYVLHRSMALSNTPCVPRA

ELEAASLPDEGFVAFTANENCVLPDKSETASATSFPPSYESVTRGLSDRVNMRTSSSIQNEDEATSMELI

APGP

SCN11A (Uniprot #: Q9UI33)
Synonyms: NaV1.9, PN5, SCN12A, SN52, hNaN
(SEQ ID NO: 2437)
MDDRCYPVIFPDERNFRPFTSDSLAAIEKRIAIQKEKKKSKDQTGEVPQPRPQLDLKASRKLPKLYGDIP

RELIGKPLEDLDPFYRNHKTFMVLNRKRTIYRFSAKHALFIFGPFNSIRSLAIRVSVHSLFSMFIIGTVIINC

VFMATGPAKNSNSNNTDIALCVFTGIYIFEALIKILARGFILDEFSFLRDPWNWLDSIVIGIAIVSYIPGITI

KLLPLRTFRVFRALKAISVVSRLKVIVGALLRSVKKLVNVIILTFFCLSIFALVGQQLFMGSLNLKCISRD

CKNISNPEAYDHCFEKKENSPEFKMCGIWMGNSACSIQYECKHTKINPDYNYTNFDNFGWSFLAMFRL

MTQDSWEKLYQQTLRTTGLYSVFFFIVVIFLGSFYLINLTLAVVTMAYEEQNKNVAAEIEAKEKMFQE

AQQLLKEEKEALVAMGIDRSSLTSLETSYFTPKKRKLFGNKKRKSFFLRESGKDQPPGSDSDEDCQKKP

QLLEQTKRLSQNLSLDHFDEHGDPLQRQRALSAVSILTITMKEQEKSQEPCLPCGENLASKYLVWNCCP

-continued

QWLCVKKVLRTVMTDPFTELAITICIIINTVFLAMEHHKMEASFEKMLNIGNLVFTSIFIAEMCLKIIALD

PYHYFRRGWNIFDSIVALLSFADVMNCVLQKRSWPFLRSFRVLRVFKLAKSWPTLNTLIKIIGNSVGAL

GSLTVVLVIVIFIFSVVGMQLFGRSFNSQKSPKLCNPTGPTVSCLRHWHMGDFWHSFLVVFRILCGEWIE

NMWECMQEANASSSLCVIVFILITVIGKLVVLNLFIALLLNSFSNEERNGNLEGEARKTKVQLALDRFR

RAFCFVRHTLEHFCHKWCRKQNLPQQKEVAGGCAAQSKDIIPLVMEMKRGSETQEELGILTSVPKTLG

VRHDWTWLAPLAELEDDVEFSGEDNAQRITQPEPEQQAYELHQENKKPTSQRVQSVEIDMFSEDEPHL

TIQDPRKKSDVTSILSECSTIDLQDGFGWLPEMVPKKQPERCLPKGFGCCFPCCSVDKRKPPWVIWWNL

RKTCYQIVKHSWFESFIIFVILLSSGALIFEDVHLENQPKIQELLNCTDIIFTHIFILEMVLKWVAFGFGKY

FTSAWCCLDFIIVIVSVTTLINLMELKSFRTLRALRPLRALSQFEGMKVVVNALIGAIPAILNVLLVCLIF

WLVFCILGVYFFSGKFGKCINGTDSVINYTIITNKSQCESGNFSWINQKVNFDNVGNAYLALLQVATFK

GWMDIIYAAVDSTEKEQQPEFESNSLGYIYFVVFIIFGSFFTLNLFIGVIIDNFNQQQKKLGG

QDIFMTEEQKKYYNAMKKLGSKKPQKPIPRPLNKCQGLVFDIVTSQIFDIIIISLIILNM

ISMMAESYNQPKAMKSILDHLNWVFVVIFTLECLIKIFALRQYYFTNGWNLFDCVVVLLSIVSTMISTLE

NQEHIPFPPTLFRIVRLARIGRILRLVRAARGIRTLLFALMMSLPSLFNIGLLLFLIMFIYAILGMNWFSKV

NPESGIDDIFNFKTFASSMLCLFQISTSAGWDSLLSPMLRSKESCNSSSENCHLPGIATSYFVSYIIISFLIV

VNMYIAVILENFNTATEESEDPLGEDDFDIFYEVWEKFDPEATQFIKYSALSDFADALPEPLRVAKPNKY

QFLVMDLPMVSEDRLHCMDILFAFTARVLGGSDGLDSMKAMMEEKFMEANPLKKLYEPIVTTTKRKE

EERGAAIIQKAFRKYMMKVTKGDQGDQNDLENGPHSPLQTLCNGDLSSFGVAKGKVHCD

SCN3A (Uniprot #: Q9NY46)
Synonyms: NaV1.3, KIAA1356, NAC3
(SEQ ID NO: 2438)
MAQALLVPPGPESFRLFTRESLAAIEKRAALEKAKKPKKEQDNDDENKPKPNSDLEAGKNLPFIYGDIP

PEMVSEPLEDLDPYYINKKTFIVMNKGKAIFRFSATSALYILTPLNPVRKIAIKILVHSLFSMLIMCTILTN

CVFMTLSNPPDWTKNVEYTFTGIYTFESLIKILARGFCLEDFTFLRDPWNWLDFSVIVMAYVTEFVSLG

NVSALRTFRVLRALKTISVIPGLKTIVGALIQSVKKLSDVMILTVFCLSVFALIGLQLFMGNLRNKCLQW

PPSDSAFETNTTSYFNGTMDSNGTFVNVTMSTFNWKDYIGDDSHFYVLDGQKDPLLCGNGSDAGQCP

EGYICVKAGRNPNYGYTSFDTFSWAFLSLFRLMTQDYWENLYQLTLRAAGKTYMIFFVLVIFLGSFYL

VNLILAVVAMAYEEQNQATLEEAEQKEAEFQQMLEQLKKQQEEAQAVAAASAASRDFSGIGGLGELL

ESSSEASKLSSKSAKEWRNRRKKRRQREHLEGNNKGERDSFPKSESEDSVKRSSFLFSMDGNRLTSDKK

FCSPHQSLLSIRGSLFSPRRNSKTSIFSFRGRAKDVGSENDFADDEHSTFEDSESRRDSLFVPHRHGERRN

SNVSQASMSSRMVPGLPANGKMHSTVDCNGVVSLVGGPSALTSPTGQLPPEGTTTETEVRKRRLSSYQ

ISMEMLEDSSGRQRAVSIASILTNTMEELEESRQKCPPCWYRFANVFLIWDCCDAWLKVKHLVNLIVM

DPFVDLAITICIVLNTLFMAMEHYPMTEQFSSVLTVGNLVFTGIFTAEMVLKIIAMDPYYYFQEGWNIFD

GIIVSLSLMELGLSNVEGLSVLRSFRLLRVFKLAKSWPTLNMLIKIIGNSVGALGNLTLVLAIIVFIFAVV

GMQLFGKSYKECVCKINDDCTLPRWHMNDFFHSFLIVFRVLCGEWIETMWDCMEVAGQTMCLIVFML

VMVIGNLVVLNLFLALLLSSFSSDNLAATDDDNEMNNLQIAVGRMQKGIDYVKNKMRECFQKAFFRK

PKVIEIHEGNKIDSCMSNNTGIEISKELNYLRDGNGTTSGVGTGSSVEKYVIDENDYMSFINNPSLTVTVP

IAVGESDFENLNTEEFSSESELEESKEKLNATSSSEGSTVDVVLPREGEQAETEPEEDLKPEACFTEGCIK

KFPFCQVSTEEGKGKIWWNLRKTCYSIVEHNWFETFIVFMILLSSGALAFEDIYIEQRKTIKTMLEYADK

VFTYIFILEMLLKWVAYGFQTYFTNAWCWLDFLIVDVSLVSLVANALGYSELGAIKSLRTLRALRPLRA

LSRFEGMRVVVNALVGAIPSIMNVLLVCLIFWLIFSIMGVNLFAGKFYHCVNMTTGNMFDISDVNNLSD

CQALGKQARWKNVKVNFDNVGAGYLALLQVATFKGWMDIMYAAVDSRDVKLQPVYEENLYMYLY

-continued

FVIFIIFGSFFTLNLFIGVIIDNFNQQKKKFGGQDIFMTEEQKKYYNAMKKLGSKKPQKPIPRPANKFQG

MVFDFVTRQVFDISIMILICLNMVTMMVETDDQGKYMTLVLSRINLVFIVLFTGEFVLKLVSLRHYYFTI

GWNIFDFVVVILSIVGMFLAEMIEKYFVSPTLFRVIRLARIGRILRLIKGAKGIRTLLFALMMSLPALFNIG

LLLFLVMFIYAIFGMSNFAYVKKEAGIDDMFNFETFGNSMICLFQITTSAGWDGLLAPILNSAPPDCDPD

TIHPGSSVKGDCGNPSVGIFFFVSYIIISFLVVVNMYIAVILENFSVATEESAEPLSEDDFEMFYEVWEKF

DPDATQFIEFSKLSDFAAALDPPLLIAKPNKVQLIAMDLPMVSGDRIHCLDILFAFTKRVLGESGEMDAL

RIQMEDRFMASNPSKVSYLPITTTLKRKQEEVSAAIIQRNFRCYLLKQRLKNISSNYNKLAIKGRIDLPIK

QDMIIDKLNGNSTPEKTDGSSSTTSPPSYDSVTKPDKEKFEKDKPEKESKGKEVRENQK

CACNA1H (Uniprot #: O95180)
Synonyms: CaV3.2, CAC1H (SEQ ID NO: 2439)

MTEGARAADEVRVPLGAPPPGPAALVGASPESPGAPGREAERGSELGVSPSESPAAERGAELGADEEQ

RVPYPALAATVFFCLGQTTRPRSWCLRLVCNPWFEHVSMLVIMLNCVTLGMFRPCEDVECGSERCNIL

EAFDAFIFAFFAVEMVIKMVALGLFGQKCYLGDTWNRLDFFIVVAGMMEYSLDGHNVSLSAIRTVRVL

RPLRAINRVPSMRILVTLLLDTLPMLGNVLLLCFFVFFIFGIVGVQLWAGLLRNRCFLDSAFVRNNNLTF

LRPYYQTEEGEENPFICSSRRDNGMQKCSHIPGRRELRMPCTLGWEAYTQPQAEGVGAARNACINWN

QYYNVCRSGDSNPHNGAINFDNIGYAWIAIFQVITLEGWVDIMYYVMDAHSFYNFIYFILLIIVGSFFMI

NLCLVVIATQFSETKQRESQLMREQRARHLSNDSTLASFSEPGSCYEELLKYVGHIFRKVKRRSLRLYA

RWQSRWRKKVDPSAVQGQGPGHRQRRAGRHTASVHHLVYHHHHHHHHYHFSHGSPRRPGPEPGA

CDTRLVRAGAPPSPPSPGRGPPDAESVHSIYHADCHIEGPQERARVAHAAATAAASLRLATGLGTMNY

PTILPSGVGSGKGSTSPGPKGKWAGGPPGTGGHGPLSLNSPDPYEKIPHVVGEHGLGQAPGHLSGLSVP

CPLPSPPAGTLTCELKSCPYCTRALEDPEGELSGSESGDSDGRGVYEFTQDVRHGDRWDPTRPPRATDT

PGPGPGSPQRRAQQRAAPGEPGWMGRLWV

TFSGKLRRIVDSKYFSRGIMMAILVNTLSMGVEYHEQPEELTNALEISNIVFTSMFALEMLLKLLACGPL

GYIRNPYNIFDGIIVVISVWEIVGQADGGLSVLRTFRLLRVLKLVRFLPALRRQLVVLVKTMDNVATFC

TLLMLFIFIFSILGMHLFGCKFSLKTDTGDTVPDRKNFDSLLWAIVTVFQILTQEDWNVVLYNGMASTSS

WAALYFVALMTFGNYVLFNLLVAILVEGFQAEGDANRSDTDEDKTSVHFEEDFHKLRELQTTELKMC

SLAVTPNGHLEGRGSLSPPLIMCTAATPMPTPKSSPFLDAAPSLPDSRRGSSSSGDPPLGDQKPPASLRSS

PCAPWGPSGAWSSRRSSWSSLGRAPSLKRRGQCGERESLLSGEGKGSTDDEAEDGRAAPGPRATPLRR

AESLDPRPLRPAALPPTKCRDRDGQVVALPSDFFLRIDSHREDAAELDDDSEDSCCLRLHKVLEPYKPQ

WCRSREAWALYLFSPQNRFRVSCQKVITHKMFDHVVLVFIFLNCVTIALERPDIDPGSTERVFLSVSNYI

FTAIFVAEMMVKVVALGLLSGEHAYLQSSWNLLDGLLVLVSLVDIVVAMASAGGAKILGVLRVLRLL

RTLRPLRVISRAPGLKLVVETLISSLRPIGNIVLICCAFFIIFGILGVQLFKGKFYYCEGPDTRNISTKAQCR

AAHYRWVRRKYNFDNLGQALMSLFVLSSKDGWVNIMYDGLDAVGVDQQPVQNHNPWMLLYFISFL

LIVSFFVLNMFVGVVVENFHKCRQHQEALEARRREEKRLRRLERRRSTFPSPEAQRRPYYADYSPTRR

SIHSLCTSHYLDLFITFIICVNVITMSMEHYNQPKSLDEALKYCNYVFTIVFVFEAALKLVAFGFRRFFKD

RWNQLDLAIVLLSLMGITLEEIEMSAALPINPTIIRIMRVLRIARVLKLLKMATGMRALLDTVVQALPQV

GNLGLLFMLLFFIYAALGVELFGRLECSEDNPCEGLSRHATFSNFGMAFLTLFRVSTGDNWNGIMKDTL

RECSREDKHCLSYLPALSPVYFVTFVLVAQFVLVNVVVAVLMKHLEESNKEAREDAELDAEIELEMAQ

GPGSARRVDADRPPLPQESPGARDAPNLVARKVSVSRMLSLPNDSYMFRPVVPASAPHPRPLQEVEME

TYGAGTPLGSVASVHSPPAESCASLQIPLAVSSPARSGEPLHALSPRGTARSPSLSRLLCRQEAVHTDSLE

GKIDSPRDTLDPAEPGEKTPVRPVTQGGSLQSPPRSPRPASVRTRKHTFGQRCVSSRPAAPGGEEAEASD

-continued

PADEEVSHITSSACPWQPTAEPHGPEASPVAGGERDLRRLYSVDAQGFLDKPGRADEQWRPSAELGSG

EPGEAKAWGPEAEPALGARRKKKMSPPCISVEPPAEDEGSARPSAAEGGSTTLRRRTPSCEATPHRDSL

EPTEGSGAGGDPAAKGERWGQASCRAEHLTVPSFAFEPLDLGVPSGDPFLDGSHSVTPESRASSSGAIV

PLEPPESEPPMPVGDPPEKRRGLYLTVPQCPLEKPGSPSATPAPGGGADDPV

HCN1 (Uniprot #: O60741)
Synonyms: BCNG1
(SEQ ID NO: 2440)
MEGGGKPNSSSNSRDDGNSVFPAKASATGEAGPAAAEKRLGTPPGGGGAGAKEHGNSVCFKVDGGGG

GGGGGGGGEEPAGGFEDAEGPRRQYGFMQRQFTSMLQPGVNKFSLRMFGSQKAVEKEQERVKTAGF

WIIHPYSDFRFYWDLIMLIMMVGNLVIIPVGITFFTEQTTTPWIIFNVASDTVFLLDLIMNFRTGTVNEDS

SEIILDPKVIKMNYLKSWFVVDFISSIPVDYIFLIVEKGMDSEVYKTARALRIVRFTKILSLLRLLRLSRLIR

YIHQWEEIFHMTYDLASAVVRIFNLIGMMLLLCHWDGCLQFLVPLLQDFPPDCWVSLNEMVNDSWGK

QYSYALFKAMSHMLCIGYGAQAPVSMSDLWITMLSMIVGATCYAMFVGHATALIQSLDSSRRQYQEK

YKQVEQYMSFHKLPADMRQKIHDYYEHRYQGKIFDEENILNELNDPLREEIVNFNCRKLVATMPLFAN

ADPNFVTAMLSKLRFEVFQPGDYIIREGAVGKKMYFIQHGVAGVITKSSKEMKLTDGSYFGEICLLTKG

RRTASVRADTYCRLYSLSVDNFNEVLEEYPMMRRAFETVAIDRLDRIGKKNSILLQKFQKDLNTGVFN

NQENEILKQIVKHDREMVQAIAPINYPQMTTLNSTSSTTTPTSRMRTQSPPVYTATSLSHSNLHSPSPSTQ

TPQPSAILSPCSYTTAVCSPPVQSPLAARTFHYASPTASQLSLMQQQPQQQVQQSQPPQTQPQQPSPQPQ

TPGSSTPKNEVHKSTQALHNTNLTREVRPLSASQPSLPHEVSTLISRPHPTVGESLASIPQPVTAVPGTGL

QAGGRSTVPQRVTLFRQMSSGAIPPNRGVPPAPPPPAAALPRESSSVLNTDPDAEKPRFASNL

HCN2 (Uniprot #: Q9UL51)
Synonyms:BCNG2
(SEQ ID NO: 2441)
MDARGGGRPGESPGATPAPGPPPPPPPAPPQQQPPPPPPAPPPGPGPAPPQHPPRAEALPPEAADEGGP

RGRLRSRDSSCGRPGTPGAASTAKGSPNGECGRGEPQCSPAGPEGPARGPKVSFSCRGAASGPAPGPGP

ALEAGSEEAGPAGEPRGSQASFMQRQFGALLQPGVNKFSLRMFGSQKAVEREQERVKSAGAWIIHPYS

DFRFYWDFTMLLFMVGNLIIIPVGITFFKDETTAPWIVFNVVSDTFFLMDLVLNFRTGIVIEDNTEIILDPE

KIKKKYLRTWFVVDFVSSIPVDYIFLIVEKGIDSEVYKTARALRIVRFTKILSLLRLLRLSRLIRYIHQWEE

IFHMTYDLASAVMRICNLISMMLLLCHWDGCLQFLVPMLQDFPRNCWVSINGMVNHSWSELYSFALF

KAMSHMLCIGYGRQAPESMTDIWLTMLSMIVGATCYAMFIGHATALIQSLDSSRRQYQEKYKQVEQY

MSFHKLPADFRQKIHDYYEHRYQGKMFDEDSILGELNGPLREEIVNFNCRKLVASMPLFANADPNFVT

AMLTKLKFEVFQPGDYIIREGTIGKKMYFIQHGVVSVLTKGNKEMKLSDGSYFGEICLLTRGRRTASVR

ADTYCRLYSLSVDNFNEVLEEYPMMRRAFETVAIDRLDRIGKKNSILLHKVQHDLNSGVFNNQENAIIQ

EIVKYDREMVQQAELGQRVGLFPPPPPPPQVTSAIATLQQAAAMSFCPQVARPLVGPLALGSPRLVRRP

PPGPAPAAASPGPPPPASPPGAPASPRAPRTSPYGGLPAAPLAGPALPARRLSRASRPLSASQPSLPHGAP

GPAASTRPASSSTPRLGPTPAARAAAPSPDRRDSASPGAAGGLDPQDSARSRLSSNL

ANO1 (Uniprot #: Q5XXA6)
Synonyms: DOG1, ORAOV2, TAOS2, TMEM16A
(SEQ ID NO: 2442)
MRVNEKYSTLPAEDRSVHIINICAIEDIGYLPSEGTLLNSLSVDPDAECKYGLYFRDGRRKVDYILVYHH

KRPSGNRTLVRRVQHSDTPSGARSVKQDHPLPGKGASLDAGSGEPPMDYHEDDKRFRREEYEGNLLE

AGLELERDEDTKIHGVGFVKIHAPWNVLCREAEFLKLKMPTKKMYHINETRGLLKKINSVLQKITDPIQ

PKVAEHRPQTMKRLSYPFSREKQHLFDLSDKDSFFDSKTRSTIVYEILKRTTCTKAKYSMGITSLLANGV

YAAAYPLHDGDYNGENVEFNDRKLLYEEWARYGVFYKYQPIDLVRKYFGEKIGLYFAWLGVYTQML

IPASIVGIIVFLYGCATMDENIPSMEMCDQRHNITMCPLCDKTCSYWKMSSACATARASHLFDNPATVF

```
-continued
FSVFMALWAATFMEHWKRKQMRLNYRWDLTGFEEEEEAVKDHPRAEYEARVLEKSLKKESRNKEKR

RHIPEESTNKWKQRVKTAMAGVKLTDKVKLTWRDRFPAYLTNLVSIIFMIAVTFAIVLGVIIYRISMAA

ALAMNSSPSVRSNIRVTVTATAVIINLVVIILLDEVYGCIARWLTKIEVPKTEKSFEERLIFKAFLLKFVNS

YTPIFYVAFFKGRFVGRPGDYVYIFRSFRMEECAPGGCLMELCIQLSIIMLGKQLIQNNLFEIGIPKMKKL

IRYLKLKQQSPPDHEECVKRKQRYLVDYNLEPFAGLTPLYMEMIIQFGFVTLFVASFPLAPLFALLNNIIE

IRLDAKKFVTELRRPVAVRAKDIGIWYNILRGIGKLAVIINAFVISFTSDFIPRLVYLYMYSKNGTMHGF

VNHTLSSFNVSDFQNGTAPNDPLDLGYEVQICRYKDYREPPWSENKYDISKDFWAVLAARLAFVIVFQ

NLVMFMSDFVDWVIPDIPKDISQQIHKEKVLMVELFMREEQDKQQLLETWMEKERQKDEPPC

NHHNTKACPDSLGSPAPSHAYHGGVL
```

Figure 5B:
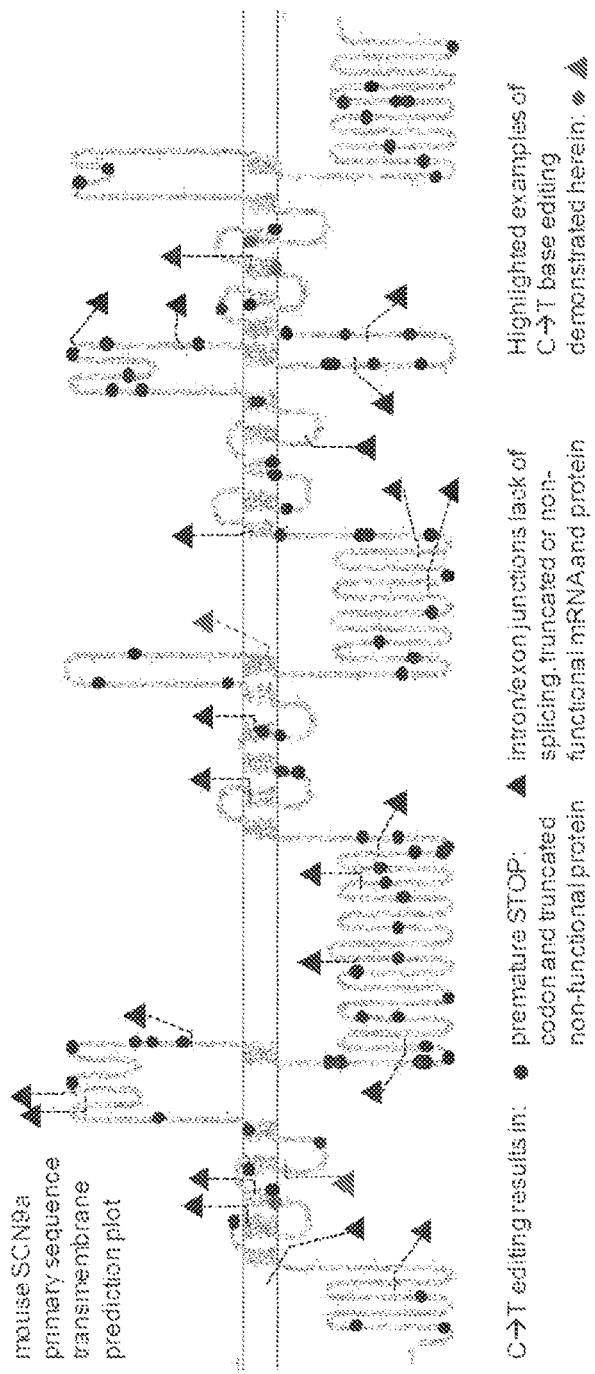
Figure 6B:
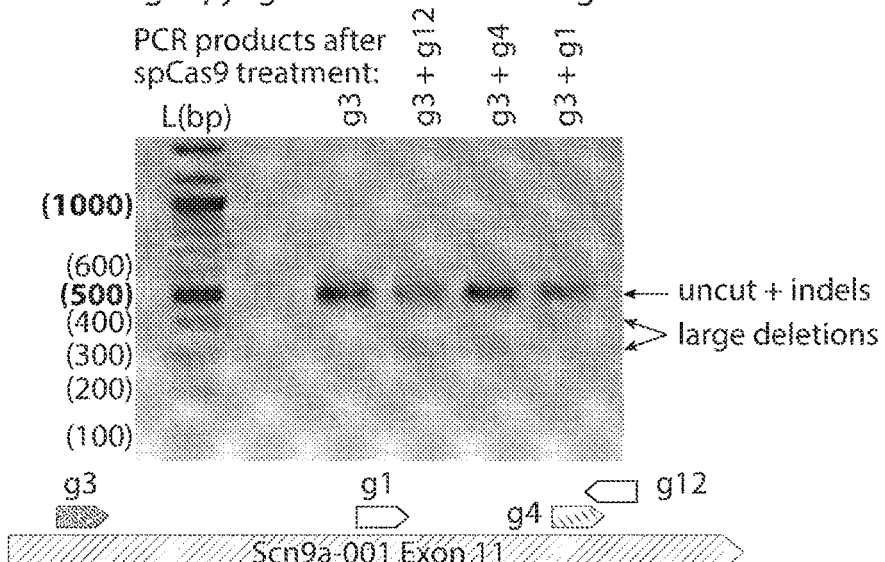
Figure 6C:
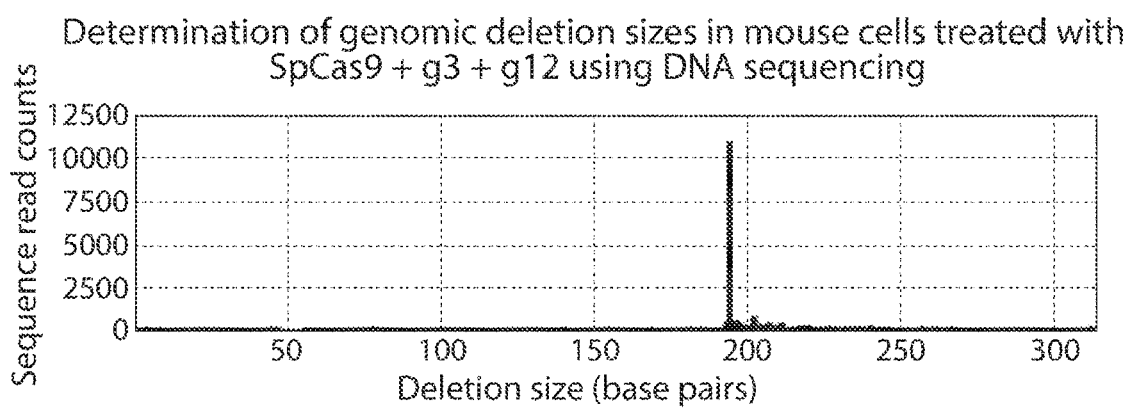

Example 3: C to T Base Editing to Introduce a Premature Stop Codon in Mouse Neuro-2a Cells On day 1, a culture of mouse Neuro-2a cells (ATCC) was resuspended using trypsin (TrypLE), and diluted to 1.25× $10^5$ cells/mL with DMEM supplemented with 10% FBS and no antibiotics. This suspension of cells (250 µL) was used to seed a 48-well plate coated with poly-D-Lysine, and incubated at 37° C. with 5% $CO_2$ for 24 hours. On day 2, each well was treated with a cationic lipid-DNA complex comprising 1.5 µL Lipofectamine 3000 and 1 µL of P3000 Reagent (ThermoFisher Scientific), 750 ng of base editor and 250 ng of sgRNA expression plasmids prepared as per the manufacturer's recommendation in a total volume of 25 µL DMEM. The base editing expression vector used the base editor 4 (BE4) architecture as described in Komor et al. 2017.[51] The sgRNA expression plasmid contained the protospacer RNA sequence and the *S. pyogenes* guide-RNA scaffold driven by a U6 promoter. The transfected Neuro-2a cells were incubated for 72 hours in the same media. On day 5, the cells were resuspended with trypsin (TrypLE), centrifuged, and the cell pellets were washed three times with PBS. The cells were treated with 75 µL of lysis buffer (comprising: 10 mM Tris-HCl pH 8, 0.05% sodium dodecyl sulfate, 25 ug/mL Proteinase K) and incubated at 37° C. for 1 hour in a thermocycler, followed by 80° C. for 20 minutes. The lysate was diluted 1:25 in water, and the target genomic loci were PCR amplified for high-throughput DNA sequencing as described in Komor et al. 2016.[52] See FIGS. 4-6 for non-limiting examples of the results obtained from C→T base editing treatments using guide-RNAs targeted to the NaV1.7/SCN9A gene in the mouse Neuro-2a cell line.

REFERENCES

1 Waxman, S. G. & Zamponi, G. W. Regulating excitability of peripheral afferents: emerging ion channel targets. Nature neuroscience 17, 153-163, (2014).
2 Guedon, J. M. et al. Current gene therapy using viral vectors for chronic pain. Molecular pain 11, 27, (2015).
3 Kumar, S., Ruchi, R., James, S. R. & Chidiac, E. J. Gene therapy for chronic neuropathic pain: how does it work and where do we stand today? Pain Med 12, 808-822, (2011).
4 Sapunar, D., Kostic, S., Banozic, A. & Puljak, L. Dorsal root ganglion—a potential new therapeutic target for neuropathic pain. Journal of pain research 5, 31-38, (2012).
5 Komor, A. C., Kim, Y. B., Packer, M. S., Zuris, J. A. & Liu, D. R. Programmable editing of a target base in genomic DNA without double-stranded DNA cleavage. Nature 533, 420-424, (2016).
6 Cong, L. et al. Multiplex genome engineering using CRISPR/Cas systems. Science 339, 819-823, (2013).
7 Jinek, M. et al. A programmable dual-RNA-guided DNA endonuclease in adaptive bacterial immunity. Science 337, 816-821, (2012).
8 Mali, P. et al. RNA-guided human genome engineering via Cas9. Science 339, 823-826, (2013).
9 Ran, F. A. et al. Double nicking by RNA-guided CRISPR Cas9 for enhanced genome editing specificity. Cell 154, 1380-1389, (2013). 10 Guilinger, J. P., Thompson, D. B. & Liu, D. R. Fusion of catalytically inactive Cas9 to FokI nuclease improves the specificity of genome modification. Nature biotechnology 32, 577-582, (2014).
11 Tsai, S. Q. et al. Dimeric CRISPR RNA-guided FokI nucleases for highly specific genome editing. Nature Biotechnology 32, 569-576, (2014).
12 Zetsche, B. et al. Cpf1 is a single RNA-guided endonuclease of a class 2 CRISPR-Cas system. Cell 163, 759-771, (2015).
13 Gao, F., Shen, X. Z., Jiang, F., Wu, Y. & Han, C. DNA-guided genome editing using the Natronobacterium gregoryi Argonaute. Nature Biotechnology 34, 768-773, (2016).
14 Cradick, T. J., Fine, E. J., Antico, C. J. & Bao, G. CRISPR/Cas9 systems targeting (3-globin and CCR5 genes have substantial off-target activity. Nucleic acids research, (2013).
15 Holt, N. et al. Human hematopoietic stem/progenitor cells modified by zinc-finger nucleases targeted to CCR5 control HIV-1 in vivo. Nature Biotechnology 28, 839-847, (2010).
16 Shen, Y. & Nemunaitis, J. Herpes simplex virus 1 (HSV-1) for cancer treatment. Cancer gene therapy 13, 975-992, (2006).
17 Smith, G. Herpesvirus transport to the nervous system and back again. Annual review of microbiology 66, 153-176, (2012).
18 Burton, E. A., Fink, D. J. & Glorioso, J. C. Gene delivery using herpes simplex virus vectors. DNA and cell biology 21, 915-936, (2002).
19 Kay, M. A., Glorioso, J. C. & Naldini, L. Viral vectors for gene therapy: the art of turning infectious agents into vehicles of therapeutics. Nature medicine 7, 33-40, (2001).
20 Epstein, A. L. HSV-1-based amplicon vectors: design and applications. Gene therapy 12 Suppl 1, S154-158, (2005).
21 Steiner, I., Kennedy, P. G. & Pachner, A. R. The neurotropic herpes viruses: herpes simplex and varicella-zoster. The Lancet. Neurology 6, 1015-1028, (2007).

22. Lancaster, K. Z. & Pfeiffer, J. K. Limited trafficking of a neurotropic virus through inefficient retrograde axonal transport and the type I interferon response. PLoS pathogens 6, e1000791, (2010).

23. Hotta, H. [Neurotropic viruses—classification, structure and characteristics]. Nihon rinsho. Japanese journal of clinical medicine 55, 777-782, (1997).

24. Kleinstiver, B. P. et al. High-fidelity CRISPR-Cas9 nucleases with no detectable genome-wide off-target effects. Nature 529, 490-495, (2016).

25. Slaymaker, I. M. et al. Rationally engineered Cas9 nucleases with improved specificity. Science 351, 84-88, (2016).

26. Pattanayak, V. et al. High-throughput profiling of off-target DNA cleavage reveals RNA-programmed Cas9 nuclease specificity. Nature biotechnology 31, 839-843, (2013).

27. Wu, X. et al. Genome-wide binding of the CRISPR endonuclease Cas9 in mammalian cells. Nature Biotechnology 32, 670-676, (2014).

28. Hsu, P. D. et al. DNA targeting specificity of RNA-guided Cas9 nucleases. Nature biotechnology 31, 827-832, (2013).

29. Davis, K. M., Pattanayak, V., Thompson, D. B., Zuris, J. A. & Liu, D. R. Small Molecule-Triggered Cas9 Protein With Improved Genome-Editing Specificity. Nature Chemical Biology in press, (2015).

30. Lee, J. H. et al. A monoclonal antibody that targets a NaV1.7 channel voltage sensor for pain and itch relief. Cell 157, 1393-1404, (2014).

31. Bagal, S. K. et al. Recent progress in sodium channel modulators for pain. Bioorganic & medicinal chemistry letters 24, 3690-3699, (2014).

32. King, G. F. & Vetter, I. No gain, no pain: NaV1.7 as an analgesic target. ACS chemical neuroscience 5, 749-751, (2014).

33. Martz, L. Targeting Nav1.7 in pain and itch. Science-Business eXchange 7, (2014, doi:10.1038/scibx.2014.662).

34. Cox, J. J. et al. An SCN9A channelopathy causes congenital inability to experience pain. Nature 444, 894-898, (2006).

35. Cox, J. J. et al. Congenital insensitivity to pain: novel SCN9A missense and in-frame deletion mutations. Human mutation 31, E1670-1686, (2010).

36. Goldberg, Y. P. et al. Loss-of-function mutations in the Nav1.7 gene underlie congenital indifference to pain in multiple human populations. Clinical genetics 71, 311-319, (2007).

37. Yang, Y. et al. Mutations in SCN9A, encoding a sodium channel alpha subunit, in patients with primary erythermalgia. Journal of medical genetics 41, 171-174, (2004).

38. Leipold, E. et al. A de novo gain-of-function mutation in SCN11A causes loss of pain perception. Nature genetics 45, 1399-1404, (2013).

39. Weiss, J. et al. Loss-of-function mutations in sodium channel Nav1.7 cause anosmia. Nature 472, 186-190, (2011).

40. Devigili, G. et al. Paroxysmal itch caused by gain-of-function Nav1.7 mutation. Pain 155, 1702-1707, (2014).

41. Woods, C. G., Babiker, M. O., Horrocks, I., Tolmie, J. & Kurth, I. The phenotype of congenital insensitivity to pain due to the NaV1.9 variant p.L811P. European journal of human genetics: EJHG 23, 561-563, (2015).

42. Bourinet, E. et al. Silencing of the Cav3.2 T-type calcium channel gene in sensory neurons demonstrates its major role in nociception. The EMBO journal 24, 315-324, (2005).

43. Cho, H. et al. The calcium-activated chloride channel anoctamin 1 acts as a heat sensor in nociceptive neurons. Nature neuroscience 15, 1015-1021, (2012).

44. Andre, S. et al. Axotomy-induced expression of calcium-activated chloride current in subpopulations of mouse dorsal root ganglion neurons. Journal of neurophysiology 90, 3764-3773, (2003).

45. Benarroch, E. E. HCN channels: function and clinical implications. Neurology 80, 304-310, (2013).

46. Emery, E. C., Young, G. T., Berrocoso, E. M., Chen, L. & McNaughton, P. A. HCN2 ion channels play a central role in inflammatory and neuropathic pain. Science 333, 1462-1466, (2011).

47. Shalem, O., Sanjana, N. E. & Zhang, F. High-throughput functional genomics using CRISPR-Cas9. Nature reviews. Genetics 16, 299-311, (2015).

48. Chen, S. et al. Genome-wide CRISPR screen in a mouse model of tumor growth and metastasis. Cell 160, 1246-1260, (2015).

49. Kleinstiver, B. P. et al. Engineered CRISPR-Cas9 nucleases with altered PAM specificities. Nature 523, 481-485, (2015).

50. Doench, J. G. et al. Optimized sgRNA design to maximize activity and minimize off-target effects of CRISPR-Cas9. Nature biotechnology 34, 184-191, (2016).

51. Komor, A. C. et al. Improved base excision repair inhibition and bacteriophage Mu Gam protein yields C:G-to-T:A base editors with higher efficiency and product purity. Science Advances 3, eaao4774, (2017).

52. Komor, A. C. et al. Programmable editing of a target base in genomic DNA without double-stranded DNA cleavage. Nature 533, 420-424 (2016).

EQUIVALENTS AND SCOPE

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

Furthermore, the invention encompasses all variations, combinations, and permutations in which one or more limitations, elements, clauses, and descriptive terms from one or more of the listed claims is introduced into another claim. For example, any claim that is dependent on another claim can be modified to include one or more limitations found in any other claim that is dependent on the same base claim. Where elements are presented as lists, e.g., in Markush group format, each subgroup of the elements is also disclosed, and any element(s) can be removed from the group. It should be understood that, in general, where the invention, or aspects of the invention, is/are referred to as comprising particular elements and/or features, certain embodiments of the invention or aspects of the invention consist, or consist essentially of, such elements and/or features. For purposes of simplicity, those embodiments have not been specifically set forth in haec verba herein.

It is also noted that the terms "comprising" and "containing" are intended to be open and permits the inclusion of additional elements or steps. Where ranges are given, endpoints are included. Furthermore, unless otherwise indicated or otherwise evident from the context and understanding of one of ordinary skill in the art, values that are expressed as ranges can assume any specific value or sub-range within the stated ranges in different embodiments of the invention, to the tenth of the unit of the lower limit of the range, unless the context clearly dictates otherwise.

This application refers to various issued patents, published patent applications, journal articles, and other publications, all of which are incorporated herein by reference. If there is a conflict between any of the incorporated references and the instant specification, the specification shall control.

In addition, any particular embodiment of the present invention that falls within the prior art may be explicitly excluded from any one or more of the claims. Because such embodiments are deemed to be known to one of ordinary skill in the art, they may be excluded even if the exclusion is not set forth explicitly herein. Any particular embodiment of the invention can be excluded from any claim, for any reason, whether or not related to the existence of prior art.

Those skilled in the art will recognize or be able to ascertain using no more than routine experimentation many equivalents to the specific embodiments described herein. The scope of the present embodiments described herein is not intended to be limited to the above Description, but rather is as set forth in the appended claims. Those of ordinary skill in the art will appreciate that various changes and modifications to this description may be made without departing from the spirit or scope of the present invention, as defined in the following claims.

SEQUENCE LISTING (2502 sequences)

SEQ ID NO: 1 - protein, 1368 aa, Streptococcus pyogenes [sequence omitted]

SEQ ID NO: 2 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 4 - protein, 1053 aa, Streptococcus pyogenes
MKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 5 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 6 - protein, 1053 aa, Streptococcus Aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 7 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 8 - protein, 1121 aa, Streptococcus thermophilus
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSIGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 9 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 10 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 11 - protein, 1368 aa, Streptococcus pyogenes [sequence omitted]

SEQ ID NO: 12 - protein, 1372 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 13 - protein, 1370 aa, Streptococcus mitis
MKKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLTEEKEYHKQFPTIYHLRKQLADSKEKTDLRLIYLALAHMIKYRGHFLYEEAFDIKNNDIQKIFNEFISIYDNTFEGSSLSGQNAQVEAIFTDKISKSAKRERVLKLFPDEKSTGLFSEFLKLIVGNQADFKKHFDLEDKAPLQFSKDTYDEDLENLLGQIGDDFTDLFVSAKKLYDAILLSGILTVTDPSTKAPLSASMIERYENHQNDLAALKQFIKNNLPEKYDEVFSDQSKDGYAGYIDGKTTQETFYKYIKNLLSKFEGTDYFLDKIEREDFLRKQRTFDNGSIPHQIHLQEMNAILRRQGEYYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVNQLFKENRKVTEKDIIHYLHNVDGYDGIELKGIEKQFNASLSTYHDLLKIIKDKEFMDDAKNEAILENIVHTLTIFEDREMIKQRLAQYDSLFDEKVIKALTRRHYTGWGKLSAKLINGICDKQTGNTILDYLIDDGKINRNFMQLINDDGLSFKEIIQKAQVIGKTDDVKQVVQELSGSPAIKKGILQSIKIVDELVKVMGHAPESIVIEMARENQTTARGKKNSQQRYKRIEDSLKILASGLDSNILKENPTDNNQLQNDRLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLKRYISRSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILLDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETWIDLSKLGED

SEQ ID NO: 14 - protein, 1056 aa, Staphylococcus Aureus
GSHMKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKAYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 15 - protein, 1052 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 16 - protein, 1368 aa, Streptococcus pyogenes [sequence omitted]

SEQ ID NO: 17 - protein, 1368 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 18 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 19 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 20 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 21 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 22 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 23 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 24 - protein, 1367 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 25 - protein, 1367 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYEIRIDLSQLGGD

SEQ ID NO: 26 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKASLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 27 - protein, 1368 aa, Streptococcus pyogenes
MDKKYSIGLDIGTNSVGWAVITDDYKVPSKKFKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 28 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNFGAPAAFIYFDTTIGRNRYKSIKEVLDATLIHQSITGLYETRIDLSQLGGD

SEQ ID NO: 29 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 30 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGGLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 31 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINANGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 32 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALLLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKKYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 33 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNRKDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 34 - protein, 1193 aa, Streptococcus pyogenes
PDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1367 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 37 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENLINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKIVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 38 - protein, 1279 aa, Streptococcus pyogenes
MAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 39 - protein, 543 aa, Streptococcus pyogenes MGAS2111
QELDINRLSGYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 40 - protein, 306 aa, Streptococcus pyogenes SS1447
IETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 41 - protein, 1368 aa, Streptococcus
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 42 - protein, 1345 aa, Streptococcus
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 43 - protein, 1373 aa, Streptococcus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 44 - protein, 1370 aa, Streptococcus agalactiae
MNKPYSIGLDIGTNSVGWSIITDDYKVPAKKIRVLGNTDKEYIKKNLIGALLFDGGNTAADRRLKRTARRRYTRRRNRILYLQEIFAEEMSKVDDSFFHRLEDSFLVEEDKRGSKYPIFATLQEEKYYHEKFPTIYHLRKELADKKEKADLRLVYLALAHIIKFRGHFLIEDDRFDVRNTDIQKQYQAFLEIFDTTFENNDLLSQDVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIVADSSKDGYAGYIEGKTNQEAFYKYLSKLLTKQEGSEYFLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVIGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFVFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDIFQIINDFSKRVILADANLEKINRLYQDNKENIPVDELANNIINLFTFTSLGAPAAFKFFDKIVDRKRYTSTKEVLNSTLIHQSITGLYETRIDLGKLGED

SEQ ID NO: 45 - protein, 1378 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKQEKADLRLIYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGLYRRKKLSKIVREDKEEKYSEATRKMFFYSNLMNMFKRVVRLADGSIVVRPVIETGRYMGKTAWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSKFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLSKLGED

SEQ ID NO: 46 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNITFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 47 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTIFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 48 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIIQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 49 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDDLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 50 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 51 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 52 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 53 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVVGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 54 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLRQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 55 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 56 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQHYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 57 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWERLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 58 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 59 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 60 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 61 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPKVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 62 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPLLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLDIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 63 - protein, 1370 aa, Streptococcus agalactiae
  misc_feature (117)..(117): Xaa can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 64 - protein, 1370 aa, Streptococcus agalactiae
MNKPYSIGLDIGTNSVGWSIITDDYKVPAKKMRVLGNTDKEYIKKNLIGALLFDGGNTAADRRLKRTSRRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 65 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTCRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 66 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 67 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGETLDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEREFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 68 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQFITGLYETRIDLGKLGED

SEQ ID NO: 69 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 70 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 71 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDLIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 72 - protein, 1370 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDIEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 73 - protein, 1370 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 74 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 75 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTALSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 76 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVAADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 77 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKASLSDSMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 78 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVEIRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 79 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTVKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 80 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDELFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 81 - protein, 1384 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 82 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNKGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 83 - protein, 1370 aa, Streptococcus agalactiae
MNKPYSIGLDIGTNSVGWSIITDDYKVPAKKMRVLGNTDKEYIKKNLIGALLFDGRNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 84 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDSFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 85 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVIKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 86 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVASILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 87 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIESKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 88 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNLSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIIDRKRYTSTKEVLNSTLIHQSITGLYETRIDLGKLGED

SEQ ID NO: 89 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKDIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 90 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKIILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDSLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 91 - protein, 1370 aa, Streptococcus agalactiae
  misc_feature (9)..(9): Xaa can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 92 - protein, 1370 aa, Streptococcus agalactiae
MNKPYSIGLDIGTNSVGWSIITDDYKVPAKKMRVLGNTDKEYIKKNLIGALLFDGGNTAADRRLKRIARRRYTRRRNRILYLQEIFAEKMSKVDDSFFHRLEDSFLVEEDKRGSKYPIFATLQEEKDYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPDQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEELVDKEASAEAFIHCMTNNDLYLPEEKVLPKHSLIYEKFTVYNELTKVRYKNEQGETYFFDSNIKQEIFDGVFKEYRKVSKKQLLDFLAKEFEEFRIVDVTGLDKENKAFNASLGTYHDLEKILGKDFLDNPDNESILEDIVQTLTLFEDREMIKKRLDIYKDFFTESQLKKLYRRHYTGWGRLSAKLINGIRNKENQKTILDYLIDDGSANRNFMQLIKDAGLSFKSIISKAQSGSHSDNLKEVVSELAGSPAIKKGILQSLKIVDELVKVMGYKPEQIVVEMARENQTTNQGRRNSRQRYKLLDDGVRNLASDLNGNILKEYPTDNQALQNERLFLYYLQNGRDMYTEKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 93 - protein, 1386 aa, Streptococcus agalactiae
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKNLDNPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 94 - protein, 1346 aa, Streptococcus agalactiae
MMKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 95 - protein, 1346 aa, Streptococcus agalactiae
MMKKEYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVEEDKRGSRYPIFGNIAAEVKYHDDFPTIYHLRKHLVDISQKADLRLVYLALAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYEEHQKDLKKLKDFIKVNAPAQYDDIFKDETKNGYAGYIENGVKQDEFYKYLKNTLSKIDGSDYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 96 - protein, 1345 aa, Streptococcus agalactiae
MKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 97 - protein, 1377 aa, Streptococcus caballi
MTKKNYSIGLDIGTNSVGWAVITDDYKVPAKKMKVLGNTDKKYIKKNLLGALLFDSGETAEATRLKRTARRRYTRRKNRLRYLQDIFTEEMAKVDDSFFQRLDESFLTDNDKNFDSHPIFGNKAEEDAYHQKFPTIYHLRKHLADSTEKADLRLVYLALAHMIKFRGHFLIEGELNAENTDVQKLFTDFVGVYDRTFDDSHLSEITVDAASILTEKISKSRRLENLINNYPKEKKNTLFGNLIALALGLQPNFKTNFKLSEDAKLQFSKDTYEEDLEELLGKIGDDYADLFTSSKNLYDAILLSGILTVDDNSTKAPLSASMIKRYVEHHEDLEKLKEFIKANKSELYHDIFKDKTQNGYAGYIENGVKQDEFYKYLKGILTKINGSDYFLDKIEREDFLRKQRTFDNGSIPHQIHLQEMHAILRRQGDYYPFLKENQEEIEKILTFRIPYYVGPLARKDSRFAWAEYRSDEKITPWNFDKVIDKEKSAEKFITRMTLNDLYLPEEKVLPKHSHVYETFAVYNELTKVKYVNEQGKDSFFDSNMKQEIFDHVFKENRKVTKEKLLNYLDKEFPEYRIQDLVGLDKENKSFNASLGTYHDLKKILDKSFLDDKVNEEVIEDIIKTLTLFEDREMIQQRLQKYSDIFTKQQLKKLERRHYTGWGRLSYKLINGIRNKENNKTILDYLIDDGSANRNFMQLINDDALSFKQIIQEAQVVGDVDDIETVVHDLPGSPAIKKGILQSVKIVDELIKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLGIVRARKAEWVRLYKSGLISKRKFDNLTKAERGGLTEADKAGFIKRQLVETRQITKHVAQILDARFNTERDENDKVIRDVKVITLKSNLVSQFRKEFKFYKVREINDYHHAHDAYLNAVVGTALLKKYPKLAPEFVYGEYKKYDVRKLVAKSSDDHSEMGKATAKYFFYSNLMNFFKRVIRYSNGKVIVRPVVEYSKDTGEIAWNKRTDFEKVRKVLSYPQVNIVKKVETQTGGFSKESILPKGDSDKLIPRKTKKVLWEPKKYGGFDSPTVAYSVLVVADVEKGKTKKLKTVKELVGISIMERSFFEKNPVEFLKNKGYQNVQEDKLMKLPKYSLFEFEGGRRRLLASATELQKGNEIMLSAHLVALLYHAHRIGNFNSAEHLKYVSEHKKEFEEVLSCVENFANVYVDVEKNLSKIRAAADSMDNFSIEEISDSFINLLTLTALGAPADFNFLGEKIPRKRYNSTKECLNATLIHQSITGLYETRIDLSKLGEE

SEQ ID NO: 98 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 99 - protein, 1345 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 100 - protein, 1365 aa, Streptococcus constellatus
MTQKYSIGLDIGTNSVGWAIVTDDYKVPAKKMKILGNTNKQYIKKNLLGALLFDSGETAKATRLKRTARRRYTRRKNRLRYLQEIFIEEMNKVDENFFQRLDDSFLVTEDKRGSKYPIFGTLKEEKEYYKEFETIYHLRKRLADSTGKVDLRLVYLALAHMIKFRGHFLIEGQLKAENTDVQTLFNDFVEVYDKTIEESHLAEITVDALSILTEKVSKSRRLENLVKCYPTEKKNTLFGNLIALSLGLQPNFKTNFQLSEDAKLQFSKDTYEEDLEELLGKIGDDYADLFTSAKNLYDTILLSGILAVDDNSTKALLSASMIKRYEEHQKDLKKLKDFIKVNAPAQYDDIFKDETKNGYAGYIENGVKQDEFYKYLKNTLSKIDGSGYFLDKIEREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYEIFTVYNELTKVKYVNEQGEAKFFDANMKQEIFDHVFKENPKVTKDKLLNYLDKEFDEFRIVDLTGLDKENKAFNASLGTYHDLRKILDKSFLDDKANEKTIEDIIQTLTLFEDREMIRQRLQKYSDIFTKAQLKKLERRHYTGWGRLSYKLINGIRNKENNKTILEYLVDDGYANRNFMQLINDDTLPFKQIIKDAQAIDDVDDIELIVHDLPGSPAIKKGILQSIKIVDELVKVMGYNPDNIVIEMARENQTTTKGRRNSQQRLKLLQDSLTNLDNPVSIKNVENQQLQNDRLFLYYIQNGKDMYTGEELDIHHLSDYDIDHIIPQAFIKDDSIDNRVLTSSAKNRGKSDNVPNLEVVCDRKADWIRLREAGLISQRKFDNLTKAERGGLTENDKAGFIHRQLVETRQITKHVAQILDARFNPKRDDNKKVIRDVKIITLKSNLVSQFRRDFKLYKVREINDYHHAHDAYLNAVVGTALLKKYPKLTSEFVYGEYKKYDVRKFIAKSDNDEIGKATAKYFFYSNLMNFFKTEVKFADGTVVERPDIETSEDGEIAWNKQTDFKIVRKVLSYPQVNIVKKVEKQTGRFSKESILPKGDSDKLIARKTKENYWDTKKYGGFDSPTVAYSVLVVADIKKGKAKKLKTVKELVGISIMERPFFEKNPIMFLESKGYRNIQKDKLIKLPKYSLFEFEGGRRRLLASAVELQKGNEMVLPQYLNNLLYHAHRIDNSDNSEHLKYITEHKEEFGKLLSYIENFAKSYVDVDKNLEKIQLAVEKIDSFSVKEISNSFIHLLTLTALGAPADFNFLGEKIPRKRYTSTKECLNATLIHQSITGLYETQTDLSKLGED

SEQ ID NO: 101 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 102 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKPINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 103 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 104 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 105 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKCKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 106 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 107 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 108 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLASSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASASELQKGNELFLPVDYMTFLYLAAHYHELTGSSEDVLRKKYFVERHLHYFDDIIQMINDFAERHILASSNLEKINHTYHNNSDLPINERAENIINVFTFVALGAPAAFKFFDATIDRKRYTSTKEVLNATLIHQSVTGLYETRIDLSQLGEN

SEQ ID NO: 109 - protein, 1348 aa, Streptococcus equi
MKKPYTIALDIGTNSVGWVVVTDDYRVPTKKMKVLGNTERKTIKKNLIGALLFDSGDTAEGTRLKRTARPRYTRRKNRLRFLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQLQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASASELQKGNELFLPVDYMTFLYLAAHYHELTGSSEDVLRKKYFVERHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 110 - protein, 1377 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 111 - protein, 1370 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 112 - protein, 1371 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 113 - protein, 1372 aa, Streptococcus gallolyticus; identical to SEQ ID NO: 12

SEQ ID NO: 114 - protein, 1372 aa, Streptococcus infantarius; identical to SEQ ID NO: 12

SEQ ID NO: 115 - protein, 1368 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 116 - protein, 1273 aa, Streptococcus iniae
  misc_feature (1267)..(1267): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFXEVKSSF

SEQ ID NO: 117 - protein, 1267 aa, Streptococcus iniae
  misc_feature (1265)..(1265): Xaa can be any naturally occurring amino acid
  misc_feature (1267)..(1267): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYXFX

SEQ ID NO: 118 - protein, 200 aa, Streptococcus iniae
MEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 119 - protein, 1281 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDVRLSQVFRVTNVEF

SEQ ID NO: 120 - protein, 1345 aa, Streptococcus intermedius
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIEDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYIGPLARGKSDFSWLSRKSADKITPWNFDEIVDKESSAEAFINRMTNYDLYLPNQKVLPRHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKNLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIANIEKGKSKKLKLVKDLVGITIMERTIFEKNPVAFLERKGYRNVQEENIVKLPKYSLFELENGRRRLLASARELQKGNEIVLPNHLGTMLYHAKNIHKVDEPKHLDYVKKHKDEFKELLDVVSNFSKKNILAESNLEKIEELYAQNNNKDITELASSFINLLTFTAIGAPAAFKFFDNNIDRKRYTSTTEILNATLIHQSITGLYETRIDLSRLGGD

SEQ ID NO: 121 - protein, 1353 aa, Streptococcus massiliensis
MKKPYSIGLDIGTNSVGWAVVMEDYKVPSKKMKVLGNTDKQSIKKNLIGALLFDSGETAVERRLNRTTSRRYDRRRNRIRYLQHIFAEEMNRADENFFHRLKESFFVEEDKTYSKYPIFGTLEEEKNYHKNYPTIYHLRKTLADTPDKMDIRLIYLALAHIIKYRGHFLIEGDLDIENIGIQDSFKSFIEEYNTQFGTKLDSTTKVEAIFTENSSKAKRVETILGLFPDETAAGNLDKFLKLMLGNQADFKKVFDLEEKITLQFSKDSYEEDLELLLSKIDEEYAALFDLAKKVYDAVLLSNILTVKEKNTKAPLSASMIKRYEEHKDDLKAFKRFFRERLPEKYETMFKDLTKPSYAAYVSGLYKKDAKRGLVPTSKRVTEDDFYKFSKGLLIDVEGAEYFLEKIEREDFLRKQRTFDNGAIPNQVHVKELQAIILNQSKYYPFLAENKEKIEKILTFRIPYYVGPLARGNSSFAWLQRKSDEAIRPWNFEQVVDMETSASRFIERMTLHDLYLPDEKVLPRHSLIYEKYTVFNELTKVRFTPEGGKEVYFSKTDKENIFDSLFKRYRKVTKRKLKDFIEKELGYGYIDIDNIKGVEEQFNASYTTYQDLLKIIGDKEFLDNEENKDLLEEIIYILTVFEDRKMIEKRLSELNIPFENKIIKKLARKKYTGWGNLSRKLIDGIRNRETNRTILGHLIDDGFSNRNLMQLINDDGLDFKEIIRKAQTIENIDTNQALVSSLPGSPAIKKGILQSLNIVDEIIAIMGYAPTNIVIEMARENQTTQKGRDNSAQRLKKIEDGIKLLGSDLLKQNPIQDNKDLQKEKLFLYYMQNGIDLYTGQPLNCDPDSLAFYDVDHIVPRSYIKNDSFDNKVLTTSKGNRKKLDDVPAKEVVEKMENTWRRLHAAGLISDIKLSYLMKGELTEEDKAGFIRRQLVETRQITKHVARLLDEKLNRKKNENGEKLRTTKIITLKSVFASRFRANFDLYKLRELNHYHHAHDAYLNAVVAQALLKVYPKFERELVYGSYVKESIFSRKISATERMRMYNNILKFISKDKKVDQETGEIVWDKKEIENIVKKVIYSSPVNIVKKREEQSGALFKQSNMAVGYNNKLIPRKKDWSVDKYGGFIEPAESYSLAIFYTDINGKKPKKKSTIIAISRMEKKDYEKEPERFLAQKGFERVEKTIKLPKYSLFEMEKGRRRLLASSGELQKGNQVLLPEHLIRLLSYAKKVDVLVKSKDDDYDLEEHRAEFAELLDCIKKFNDMYILASSNMSKIEEIYQKNIDAPIEEVARSFVALLNFTMMGAATDFKFFGQIIPRKRYPSTTECLKSTLIHQSVTGLYETRIDLSKLGEN

SEQ ID NO: 122 - protein, 1376 aa, Streptococcus mitis
MNNKPYSIGLDIGTNSVGWAVITDDYKVPSKKMKVLGNTDKHFIKKNLLGALLFDEGTTAEDRRLKRTARRRYTRRKNRLRYLQEIFTEEMSKVDISFFHRLDDSFLVPEDKRGSKYPIFATLEEEKEYHKNFPTIYHLRKHLADSKEKADFRLIYLALAHIIKYRGHFLYEESFDIKNNDIQKIFNEFISIYDNTFEGSSLNGQNAQVEAIFTDKISKSAKRERVLKLFPDEKSTGLFSEFLKLIVGNQADFKKHFDLEEKAPLQFSKDTYDEDLENLLVQIGDDFADLFLVAKKLYDAILLSGILTVTDPSTKAPLSASMIDRYENHQKDLAALKQFIKTNLPEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKARSAEDFINKMTNYDLYLPEEKVLPKHSLLYETFAVYNELTKVKFIAEGLRDYQFLDSGQKQQIVTQLFKEKRKVTEKDIIQYLHNVDSYDGIELKGIEKQFNASLSTYHDLLKIIKDKEFMDDSKNEAILENIVHTLTIFEDREMIKQRLAHYASIFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAHGLDSNILKEHPTDNIQLQNDRLFLYYLQNGKDMYTGKSLDINQLSSCDIDHIIPQAFIKDDSLDNRVLTSSKDNRGKSDNVPSLEIVQKRKAFWQQLLDSKLISERKFNNLTKAERGGLDERDKVGFIKRQLVETRQITKHVAQILDARFNTEVTEKDKKDRSVKIITLKSNLVSNFRKEFRLYKVREINDYHHAHDPYLNAVVAKAILKKYPKLEPEFVYGDYQKYDLKRYISRTKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLTPIKSGLSPEKYGGYARPTIAYSVLVIADIEKGKAKKLKRIKEMVGITVQDKKKFEANPIAYLEECGYKNINPNLIIKLPKYSLFEFNNGQRRLLASSIELQKGNELIVPYHFTALLYHAQRINKISEPIHKQYVETHQSEFKELLTAIISLSKKYIQKPNVESLLQQAFDQSDKDIYQLSESFISLLKLISFGAPGTFKFLGVEISQSNVRYQSVSSCFNATLIHQSITGLYETRIDLSKLGED

SEQ ID NO: 123 - protein, 1370 aa, Streptococcus mitis; identical to SEQ ID NO: 13

SEQ ID NO: 124 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 125 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 126 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 127 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 128 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 129 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 130 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 131 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 132 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 133 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 134 - protein, 1355 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLNKLGGD

SEQ ID NO: 135 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 136 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 137 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 138 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 139 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 140 - protein, 1355 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 141 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 142 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 143 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 144 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 145 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 146 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 147 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 148 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 149 - protein, 1359 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADKKLRKRSGKLATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKNLDHDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 150 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 151 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 152 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKHQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 153 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGQRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPDHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 154 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 155 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 156 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 157 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIIGNQADFKKHFELEEKAPLQFSKDTYEEELEVLLAQIGDNYAELFLSAKKLYDSILLSGILTVTDVGTQAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 158 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 159 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGECHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGNGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 160 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKVPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 161 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQNLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 162 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKSKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 163 - protein, 1355 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYLKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 164 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLVQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 165 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 166 - protein, 1355 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 167 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYYENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 168 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILKATLIHQSITGLYETRIDLSKLGGD

SEQ ID NO: 169 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 170 - protein, 1373 aa, Streptococcus oralis
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 171 - protein, 1371 aa, Streptococcus oralis
MENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASGLDSNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLKRYISRSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 172 - protein, 1366 aa, Streptococcus parasanguinis
MKKPYSIGLDIGTNSVGWAVITDDYKVPAKKMKVLGNTNKESIKKNLIGALLFDAGNTAADRRLKRTARRRYTRRRNRILYLQEIFAAEMNKVDESFFHRLDDSFLVPEDKRGSKYPIFGTLEEEKEYHKQFPTIYYLRKILADSKEKVDLRLIYLALAHIIKYRGHFLYEDSFDIKNNDIQKIFNEFTILYDNTFEESSLSKGNAQVEEIFTDKISKSAKRDRVLKLFPDEKSTGLFSEFLKLIVGNQADFKKHFDLEEKAPLQFSKDTYEEDLESLLGQIGDVYADLFVVAKKLYDAILLAGILSVKDPGTKAPLSASMIERYDNHQNDLSALKQFVRRNLPEKYAEVFSDDSKDGYAGYIDGKTTQEGFYKYIKNLISKIEGAEYFLEKIEREDFLRKQRTFDNGSIPHQIHLQEMNAILRHQGEYYPFLKENKDKIEQILTFRIPYYVGPLARGNSDFAWLSRNSDEAIRPWNFEEMVDKSSSAEDFIHRMTNYDLYLPEEKVLPKHSLLYETFTVYNELTKVKYIAEGMKDYQFLDSGQKKQIVNQLFKEKRKVTEKDIIHYLHNVDGYDGIELKGIEKHFNSSLSTYHDLLKIIKDKEFMDDPKNEEIFENIVHTLTIFEDRVMIKQRLNQYDSIFDEKVIKALTRRHYTGWGKLSAKLINGIRDKKTSKTILDYLIDDGYSNRNFMQLINDDGLSFKETIQKAQVVGETNDVKQVVQELPGSPAIKKGILQSIKIVDELVKVMGHAPESVVIEMARENQTTNKGKSKSQQRLKTLSDAISELGSNILKEHPTDNIQLQNDRLFLYYLQNGKDMYTGEALDINQLSNYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDDRFNAEVNEKNQKLRSVKIITLKSNLVSNFRKEFGLYKVREINDYHHAHDAYLNAVVAKAILKKYPKLEPEFVYGDYQKYDLKRYISRTKDPKEIEKATEKYFFYSNLLNFFKDKVYYADGTIIQRGNVEYSKDTGEIAWNKKRDFAIVRKVLSYPQVNIVKKTEEQTGGFSKESILPKGNSDKLIPRKTKNVQLDTTKYGGFDSPVIAYSILLVADVEKGKSKKLKTVKSLIGITIMEKVKFEANPVAFLEGKGYQNVVEENIIRLPKYSLFELENGRRRMLASAKELQKGNEMVLPSYLIALLYHAKRIQKKDEPEHLEYIKQHHSEFNDLLNFVSEFSQKYVLAESNLEKIKNLYIDNEQTNMEEIANSFINLLTFTAFGAPAVFKFFGKDIERKRYSTVTEILKATLIHQSLTGLYETRIDLSKLGEE

SEQ ID NO: 173 - protein, 1337 aa, Streptococcus parauberis
MKVLGNTDRQTVKKNMIGTLLFDSGETAEARRLKRTARRRYTRRINRIKYLQSIFDDEMSKIDSAFFQRIKDSFLVPDDKNDDRHPIFGNIKDEVDYHKNYPTIYHLRKKLADSDEKADLRLIYLALAHIIKFRGHFLIEGDLDSQNTDVNALFLKLVDTYNLMFEDDKIDTQTIDATVILTEKMSKSRRLENLIAKIPNQKKNTLFGNLISLSLGLTPNFKANFELSEDAKLQISKESFEEDLDNLLAQIGDQYADLFIAAKNLSDAILLSDILTVKGVNTKAPLSASMVQRFNEHQDDLKLLKKLVKVQLPEKYKEIFDIKDKNGYAGYINGKTSQEDFYKYIKPILSKLKGAESLISKLEREDFLRKQRTFDNGSIPHQIHLNELKSIIRRQEKYYPFLKDKQVRIEKIFTFRIPYFVGPLANGNSSFAWVKRRSNESITPWNFEEVVEQEASAKVFIERMTNFDTYLPEEKVLPKHSLLYEMFTVYNELTKVKYQAEGMRKPEFLSSEEKIEIVSNLFKTERKVTVKQLKENYFNKIRCLDSITISGVEDKFNASLGTYHDLLNIIKNQKILDDEQNQDSLEDIVLTLTLFEDEKMIAKRLSKYESIFDPSILKKLKKRHYTGWGRLSQKLINGIRDKQTGKTILDFLIEDGQANRNFMQLINDPSLDFASIIKEAQEKTIKSEKLEETIANLAGSPAIKKGILQSVKIVDEVVKVMGYEPSNIVIEMARENQSTQRGINNSRERLRKLEEVHKNIGSKILKEHEISNAQLQSDRVYLYLLQDGKDMYTGKDLDFDRLSQYDIDHIIPQSFIKDNSIDNIVLTSQESNRGKSDNVPYIAIVNKMKSYWQHQLKSGAISQRKFDNLTKAERGGLSEYDKAGFIKRQLVETRQITKHVAQILNNRFNNNVDDSSKNKRPVKIITLKSKMVSDFRKEFGFYKIREVNDYHHAHDAYLNAVVGTALLKKYPKLEAEFVYGDYKHYDLASLVVKSDTSLGKATAKMFFYSNIMNFFKKEVRLADGTVITRPQIETNTETGEIVWDKVKDIKTIRKVLSIPQINVVKKTEVQTGGFSKESILSKRDSDKLIPRKNNWDPKKYGGFGSPIIAYSVLVVAKVTKGKSQKTKSVKELVGITIMEQNEFEKDRITFLEKKGYQDIQESLIIKLPKFSLFELENGRKRLLASAKELQKGNELSLPNKYIQFLYLASRYTSFSGKEEDREKHRHFVESHLHYFDEIKDIIADFSRRYILADANLEKILTLYNEKNQFSIEEQATNMLNLFTFTGLGAPATLKFFNVDIDRKRYTSSTEILNSTLIRQSITGLYETRIDLSKIGGD

SEQ ID NO: 174 - protein, 1368 aa, Streptococcus phocae
MVEKKSYSIGLDIGTNSVGWAVITDDYKVPAKKMKVLGNTSRQSIKKNMIGALLFDEGGPAASTRVKRTTRRRYTRRKNRLCYLRDIFESEMHTIDKHFFLRLEDSFLHKSDKRYEAHPIFGTLQEEKAYHDNYPTIYHLRKALADNTEKADLRLIYLALAHIIKFRGHFLIEGALSANNTDVQQLVHALVDAYNIMFEEDQLDIEAIDVKAILTEKISKTRRLENLISNIPGQKKNGLFGNLIALSLGLTPNFKSHFNLPEDAKLQLAKDTYDEELNNLLTQIGDEYADLFLSAKNLSDAILLSDILTVNGDGTQAPLSASLIKRYEEHRQDLALLKQMFKEQLPDLYRDVFTDENKDGYAGYISGKTSQEAFYKYIKPILETLDGAEDFLTKINREDFLRKQRTFDNGSIPHQIHLGELQAILERQQAYYPFLKDNQEKIEKILTFRIPYYIGPLARGNSRFAWLTRTSDQKITPWNFDEMVDQEASAQAFIERMTNFDEYLPQEKVLPKHSLTYEYFTVYNELTKVKYVTEGMTKPEFLSAGQKEQIVELLFKKYRKVTVKQLKEDFFSKIECFDTVDISGVEDKFNASLGTYHDLLKIIKDKAFLDNSENENIIEDIILTLTLFEDKEMIANRLAVYEDLFDQNVLKQLKRRHYTGWGRLSKQLINGMRDKHTGKTILDFLKADGFINRNFMQLINDDNLSFKEEIKKAQEGGLKDSINDQIRDLAGSPAIKKGILQTINIVDEIVKIMGKAPQHIVVEMARDVQKTDIGVKQSRERMKRVQEVLKKLGSQLLKEHPVENFQLQNERLYLYYLQNGKDMYTGEELSISNLSHYDIDHIIPRSFIKDDSIDNKVLTRSEHNRGKTDNVPSIEVVKRMKPYWQKLLDTKVISQRKFDNLTKAERGGLQESDKANFIQRQLVETRQITKHVAQILDSRFNTERDEKDRPIRRVKVITLKSKFVSDFRQDFGFYKLREINDYHHAHDAYLNAVVGTALLKMYPKLASEFVYGDYQKYDLKRMVGKSGKASGHATAKYFFYSNLMNFFKSEVKLANGNIIKRSPIEVNEETGEIVWDKTKDFGTVRKVLSAPQVNIVKKTEIQTGGFSNETILSKGKSSKLIPRKNKWRDTTKYGGFNTPTVAYSVLVVAKVEKGKAKKLKPVKELVGITIMERTKFEANPIAFLESKGYHDIQEHLMITLPKYSLFELENGRRRLLASATELQKGNEMVLPQHLVTFLYRVSKRDKGTQSENMEYISNHKEKFIEIFHYIIRYAEKNVIKPKVIERLNDTFNQKFNDSDLTELSISFLNLFKFTSFGAPEKFTFLNSEIKQDDVRYRSTKECLNSTLIHQSVTGLYETRIDLSQFGGD

SEQ ID NO: 175 - protein, 1376 aa, Streptococcus pseudopneumoniae
MSNKPYSIGLDIGTNSVGWAVITDDYKVPSKKMKVLGNTDKHFIKKNLIGALLFDEGTTAEDRRLKRTARRRYTRRKNRLRYLQEIFSEEISKVDNSFFHRLDDSFLVPEDKRGSKYPIFATLTEEKEYYKQFPTIYHLRKQLADSKEKADLRLIYLTLAHMIKYRGHFLYEESFDIKNNDIQKIFNEFISIYDNTFEGSSLSGQNAQVEAIFTDKISKSTKRERVLKLFPDQKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDQSKEGYAGYIDSKTTQEAFYKYIKNLLSKIDGADYLLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEAFINKMTNYDLYLPEEKVLPKHSLLYETFAVYNELTKVKFIAEGLRDYQFLDSGQKKKIINQLFKEKRKVTEKDLIHYLHNVDGYDGIELKGIEKQFNASLSTYHDLLKIIKDKRFMDEPKNQEILENIVHTLTIFEDREMIKQRLAQYASIFDEKVIKTLTRRHYTGWGKLSAKLINCIRDRKTGKTILDYLIDDGYNNRNFMQLINDDGLSFKEIIQESQVVGKPDDVKQIVQELPGSSAIKKGILQSIKLVDELVKVMGHDPESIVIEMARENQTTARGKKNSQQRYKRIEDSLKILASGLNSNILKEHPTDNIQLQNDRLFLYYLQNGKDMYTGNPLDINHLSSYDIDHIIPQAFIKDDSLDNRVLTSSKDNRGKSDNVPSLEVVQKRKAFWQQLLESKLISERKFNNLTKAERGGLNERDKVGFIKRQLVETRQITKHVAQILDSRFNTKVNEKNQKIRTVKIITLKSNLVSNFRKEFRLYKVREINDYHHAHDAYLNAVVAKAILKKYPKLEPEFVYGDYQKYDLKRYISRSRDPKEIEKATEKYFFYSNLLNFFKEEVHYADGTIVKRENIEYSKDTGEIAWNKEIDFATIRKILSLSQVNIVKKTEEQTVGQNGGLFDNNIVSKKKVVDASKLIPIKSGLSPEKYGGYARPTIAYSVLVIADIEKGKAKKLKRIKEMVGITIQDKKKFEANPTAYLEEYGYKNINPNLIIKLPKYSLFKFNDGQRRLLASSIELQKGNELILPYHFTTLLYHAQRINKISEPIHKQYVETHQSEFEELLTTIISLSKKYIQKPIVESLLQQAFEQADKDIYQLSESFISLLKLTSFGAPGAFRFLGVEISQSNVRYQSVSSCFNATLIHQSITGLYETRIDLSKLGED

SEQ ID NO: 176 - protein, 1376 aa, Streptococcus pseudopneumoniae
MSNKPYSIGLDIGTNSVGWVIITDDYKVPSKKMKVLGNTDKHFIKKNLIGALLFDEGTTAEDRRLKRTARRRYTRRKNRLRYLQEIFAEEMNKVDSSFFHRLDDSFLVPEDKRGSKYPIFATLAEEKEYHKNFPTIYHLRKQLADSKEKADLRLIYLALAHMIKYRGHFLYEEAFDIKNNDIQKIFNEFINIYDNTFEGSSLSGQNEQVEAIFSDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYQNHQNDLASLKQFIKNNLPEKYDEVFSDQSKDGYAGYVDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDSKNEEILENIVHTLTIFEDREMIKQRLAQYDSIFDEKVIKALTRRHYTGWGKLSAKLINGIRDKQTGKTILDYLIDDGYSNRNFMQLINDDGLSFKEIIQKAQVFGKTNDVKQVVQELPGSPAIKKGILQSIKIVEELVKVMGHEPESIVIEMARENQTTTRGKKNSQQRYKRIENSLKILASGLNSKILKEHPTDNNQLQNDRLFLYYLQNGKDMYTGEALDINQLSSCDIDHIIPQAFIKDDSLDNRVLTSSKENRGKSDNVPCLEVVDKMKVFWQQLLDFKLISYRKFNNLTKAERGGLDERDKVGFIRRQLVETRQITKHVAQILDSRFNTEVTEKDKKNRNVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIVKRENIEYSKDTGEIAWNKEKDFATIKKILSLPQVNIVKKTEEQTVGQNGGLFDNNIVSKKKVVDASKLIPIKSGLSPEKYGGYARPTIAYSVLVIADIEKGKTKKLKRIKEMIGITVQDKKIFESNPIAYLEECGYKNINPNLIIKLPKYSLFEFNGGQRRLLASSIELQKGNELILPYHFTALLYHTQRINKISEPIHKQYVEAHQNEFKELLTTIISLSKKYIQKPNVESLLQQAFEQADKDIYQLSESFISLLKLTSFGAPGAFKFLGVEISQSSVRYKPNSQFLDATLIHQSITGLYETRIDLSKLGED

SEQ ID NO: 177 - protein, 1378 aa, Streptococcus pseudopneumoniae
MSNKPYSIGLDIGTNSVGWAVITDDYKVPSKKMTVLGNTDKHFIKKNLIGALLFDEGTTAEDRRLKRTARRRYTRRKNRLRYLQEIFSGEMSKVDSSFFHRLDDSFLVPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLTTLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDSKNEAILENIVHTLTIFEDREMIKQRLAQYDSLFDKKVIKALTRRHYTGWGKLSAKLINGICDKQTGNTILDYLIDDGEINRNFMQLINDDGLSFKKIIQKSQVVGETDDVKQVVRELPGSPAIKKGILQSIKIVDELVKVMDHAPESIVIEMARENQTTARGKKNSQQRYKRIEDSLKILASGLDSNILKENPTDNNQLQNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERERDGLNELDKVGFIKRQLVETRQITKHVAQILDARFNKEVTEKDKKNRNVKIITLKSNLVSNFRKEFRLYKVREINDYHHAHDAYLNAVVAKAILKKYPKLEPEFVYGDYQKNDLKRYISRSKDPKDIEKATEKYFFYSNLLNFFKEEVHYADGTIVKRENIEYSKDTGEIAWNKEKDFATIKKVLSYPQVNIVKKTEEQTVGQNGGLFDNNIVSKEKVVDASKLIPIKSGLSPEKYGGYARPTIAYSVLVIADIEKGKTKKLKRIKEMVGITIQDKKKFEANPIAYLEECGYKNINPNLIIKLPKYSLFEFNGGQRRLLASSIELQKGNELILPYHFTALLYHAQRINKFSEPIHKQYVEAHQNEFKELLTIIISLSKKYIQKPNVESLLHQAFEQADNDIYQLSESFISLLKLTSFGAPGAFKFLGAEISQSSVRYKPNSQFLDTTLIHQSITGLYETRIDLSKLGED

SEQ ID NO: 178 - protein, 1374 aa, Streptococcus pseudoporcinus
MKKRYSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 179 - protein, 1326 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 180 - protein, 1370 aa, Streptococcus sanguinis
MKKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPGLDSNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLKKYISRFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 181 - protein, 1377 aa, Streptococcus sanguinis
MKKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPGLDSNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLKRYILKSKASNTIDKATEKYFFYSNLLNFFKEKVRYADGTIKKRENIEYSNDTGEIAWNKEKDFATIKKVLSLPQVNIVKKTEEQTVGQNGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 182 - protein, 1371 aa, Streptococcus sp. F0441
MENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASGLNSKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 183 - protein, 1361 aa, Streptococcus sp. FF10
MKKPYSIGLDIGTNSVGWSVVTDDYKVPAKKMKVLGNTDKEYIKKNLIGALLFDSGETAEATRMKRTARRRYTRRRNRILYLQDIFSPELNQVDESFLHRLDDSFLVAEDKRGERHVIFGNIADEVKYHKEFPTIYHLRKHLADSSEKADLRLVYLALAHIIKYRGHFLIDEPIDIRNMNSQNLFKEFLLAFDGIQVDCYLASKHTDISGIITAKISKSRKVEAVLEQFPDQKKNSFFGNMVSLVFGLMPNFKSNFELDEDAKLQFSRDSYDEDLENLLGIIGDEYADVFVAAKKVYDSILLSGILTTNNHSTKAPLSASMIDRYDEHNSDKKLLRDFIRTNIGKEVFKEVFYDTSKNGYAGYIDGKTNQEDFYKYLKNLLQKVDGGDYFIEKIEREDFLRKQRTFDNGSIPHQVHLDEMKAILRRQGEFYPFLKENAEKIQQILTFKIPYYVGPLARGNSRFAWASYNSNEKMTPWNFDNVIDKTSSAQAFIERMTNNDLYLPDQKVLPKHSLLYQKFAVYNELTKIKYVTETGEARLFDVFLKKEIFDGLFKKERKVTKKKILNFLDKNFDEFRITDIQGLDNETGNFNASYGTYHDLLKIIGDKEFMDSSDNVDVLEDIVLSLTLFEDREMIKQRLLKYEDIFSKKVIANLTRRHYTGWGRLSAKLINGIKDKHSRKTILDYLIDDGHSNRNFMQLINDDNLSFKDEIANSQVIGDGDDLHQVVQELAGSPAIKKGILQSLKIVDELVKVMGYNPEQIVVEMARENQTTARGRNNSQQRLGSLTKAIQDFGSDILKRYPVENNQLQNDQLYLYYLQNGKDMYTGDTLDIHNLSQYDIDHIIPQSFIKDNSLDNRVLTNSKSNRGKSDNVPSNEVVKRMKGFWLKQLDAKLISQRKFDNLTKAERGGLSAEDKAGFIKRQLVETRQITKHVARILDERFNRDFDKNDKRIRNVKIVTLKSNLVSNFRKEFGFYKVREINNFHHAHDAYLNAVVAKALLIRYPKLEPEFVYGEYPKYNSYRERKSATEKMFFYSNIMNMFKTTIKLADGRVVEKPVIEANEETGEIAWDKTKHFANVKKVLSYPQVSIVKKVEEQTGGFSKESILPKGGSDKLIARKTKNNYLSTQKYGGFDSPTVAYSIMFVADIEKGKSKRLKTVKEMIGITIMERSRFESNSVTFLEEKGYRNIRENTIIKFPKYSLFELENGRRRLLASAIELQKGNEMFLPQQFVNLLYHAQHANKEDSVIYLEKHRHELSELFHHIIGVSEKTILKPKVEMTLNEAFEKHFEFDEVSELAQSFISLLKFTAFGAPGGFKFLDADIKQSNLRYQTVTEVLSSTLIHQSVTGLYETRIDLSKLGGE

SEQ ID NO: 184 - protein, 1375 aa, Streptococcus sp. M334
MSNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLQRYISKSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 185 - protein, 1371 aa, Streptococcus sp. taxon 056
MNNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPGLDSTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLKRYISKSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 186 - protein, 1364 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 187 - protein, 1366 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLTLALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 188 - protein, 1366 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 189 - protein, 1364 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFKTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 190 - protein, 1386 aa, Streptococcus suis
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLGKEFDEFRIVDLTGLDKENKVFNSSLGTYHDLRKILDKSFLDNKENEQIIEDIIQTLTLFEDREMIRQRLQKYSDIFTKAQLKKLERCHYTGWGRLSYKLINGIRNKENKKTILDYLIDDGYANRNFMQLINDDALSFKEEIAKAQVIGETDDLNQVVSDIAGSPAIKKGILQSLKIVDELVKVMGYNPANIVIEMARENQTTDKGRRNSQQRLKLLQDSLKNLDNPVNIKNVENQQLQNDRLFLYYIQNGKDMYTGETLDINNLSQYDIDHIIPQAFIKDDSFDNRVLTSSSENRGKSDNVPSIEVVRARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 191 - protein, 1300 aa, Brochothrix thermosphacta
MWGVSLFEAGKTAAERRGYRSTRRRLNHRKFRLRLLEDMFEKEILSKDPSFFIRLKEAFLSPKDEQKQFKGNILFNDKDYTDADYYEQYKTIYHLRYDLISQHRQFDIREVYLAIHHLIKYRGHFIYEDQTFTTDGNQLQHHIKAIITMINSTLNRIIIPETIDINVFEKILLDRMMNRSSKVKFLIELTGEDKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGAKSSNYEESKNIKKGLSAAYGKYSKEERLFKHIELLLAKENVLTTVEHALLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTQTSLKKWLAEHEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPVSGDEDHKLSINEILWQTNENFMQIIRNKDYLFKKIIEEQFENETALLNKQRIDELAASPANKKGIWQAIKIVKELEKVLQQPAENIFIEFARSDEESKRSTPRDKFIEKAYAQLKKETDTFNLEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSGLRRKFEFIKNRNVNDYHHAQDAFLVAFLGTNITSNYPKIEMEYLFKGYQHYLNEVGKSAAKPKFTFIVENLSKQQYNSTTGEVKWNPEVDIAKLKRILNFKQCNIVRKVEEQSGALFKETIYPVEESSSKTIPLKKHLDTAIYGGYTAVNYASYALIQFKKGRKLKREIIGIPLAVQTRIDNSETSLQAYIAEQIKSEVEILNGRILKYQLISNNGNRLYIAGPSERHNARQLIVSDEAAKVIWLISTKQADEAMFLKYYRLEHLEAVFEELIRKQAADYQIFEKLIKKIEVNKVYFYSCTYNEKVKVIEELLKITQANATNGDLKLLKMSNREGRLGSVSVALDFKIINQSVTGLYQSIEDYNN

SEQ ID NO: 192 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 193 - protein, 1389 aa, Cloning vector pYB196
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGPPKKKRKVYPYDVPDYA

SEQ ID NO: 194 - protein, 1335 aa, Clostridiales bacterium S5-A11
MKNYTIGLDIGTNSVGWAVIKDDLTLVRKKIKISGNTDKKEVKKNLWGSFLFEQGDTAQDTRVKRIARRRYERRRFRIRELQKIFDKSMGEVDSNFFHRLDESFLVEEDKEYSKYPIFSNEKEDKNYYDKYPTIYHLRKDLADSNQKADLRLIYLALAHMIKYRGHFLIEGDLKMDGISISESFQEFIDSYNEVCALEDENLEIIYNDELLTQIENIFKQDISRSKKLDQAIALFQGVKRQSLFGIFLTLIVGNKANFQKIFNLEDDIKLDLKEEDYDENLEELLSNIDEGYRDVFLQAKNVYNAIELSKILKTDGKETKAPLSAQMVELYNQHREDLKKYKDYIKAYLPEKYGETFKDATKNGYAGYIDGKTSQEDFYKFVKAQLKGEENGEYFLEAIENENFLRKQRSFYNGVIPYQIHLQELTAVLDQQEKHYSFLKENRDKIISLLTFRIPYYVGPLAKGESRFAWLERSNSEEKIKPWNFDKIVDIDKSAELFIENLTSRDTYLPDEPVLPKRSLIYQKFTIFNELTKISYIDERGILQNFSSREKIAIFNDLFKNKSKVTKNQLVKYIENKEQIIAPEIKGIEDSFNSNYSTYIDLSKIPDMKKLLEKDEDEILEEIIKILTIFEDRKMRKRQLMKFKDKLSEKAINQLSKKHYTGWGQLSEKLINGIRDEQSNKTILDYLIEDNGCPKNMNRNFMQLINDDTLSFKEKIRKAQDINQVNDIKEIVKDLPGSPAIKKGIYQSIRIVDEIIRKMKDRPKNIVIEMARENQTTQEGKNKSKARLKKIQEGLENLDSVHVEKQALDEEMLKSPKYYLYCLQNGKDIYTGKDLDIGQLQTYDIDHIIPRSFITDNSFDNLVLTSSTVNRGKLDNVPSPDIVRQQKGFWKQLLRAGLMSQRKFNNLTKGKLTDRDRQQFINRQLVETRQITKHVANLLSHHLNEKKEVGEINIVLLKSALTSQFRKKFDFYKVREVNDYHHAHDAYLNGVIALKLLELYPYMAKDLIYGKYSYHRKIEGDKATQAKYKMSNIIERFSQDLLANPDGEIAWEKDKDLNTIRKVLSSKQINIIKKAEEGKGRLFKETINSRPSKKTEKRIPIKNNLDPNIYGGYIEEKMAYYIAINYLENGKTKKAIVGISIKDKKDFEGQTTEYLGKIGFNKASIINSFKNYTLFELENGSRRMIVGASKENDSKGELQKGNQMYLPQNLLEFVYHLKHYNEDETSHKFIVEHKAYFDELLNYIVEFANKYLELENSIEKIKDLYHGKGPDVEEKELVESFINLLAITKCGPAADITFLGEKISRKRYRSTNCLWGSEVIFQSPTGLYETRLRLE

SEQ ID NO: 195 - protein, 1384 aa, CRISPR-mediated gene targeting vector p(bhsp68-Cas9)
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSGGAAG

SEQ ID NO: 196 - protein, 1332 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKSDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGPSDVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLEDN

SEQ ID NO: 197 - protein, 1337 aa, Enterococcus
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 198 - protein, 1288 aa, Enterococcus
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 199 - protein, 1079 aa, Enterococcus durans IPLA 655
MDEEAKIQLSKESYEEELESLLEKSGEEFRDVFLQAKKVYDAILLSDILSTKKQNSKAKLSLGMIERYDSHKKDLEELKQFVKANLPEKTAIFFKDSSKNGYAGYIDGKTTQEDFYKFLKKELNGIAGSERFMEKVDQENFLLKQRTTANGVIPHQVHLTELKAIIERQKPYYPSLEEARDKMIRLLTFRIPYYVGPLAQGEETSSFAWLERKTPEKVTPWNATEVIDYSASAMKFIQRMINYDTYLPTEKVLPKHSILYQKYTIFNELTKVAYKDERGIKHQFSSKEKREIFKELFQKQRKVTVKKLQQFLSANYNIEDAEILGVDKAFNSSYATYHDFLDLAKPNTERVAELLEQPEMNAMFEDIVKILTIFEDREMIRTQLKKYQSVLGDGFFKKLVKKHYTGWGRLSERLINGIRDKKTNKTILDYLIDDDDFPYNRNRNFMQLINDDSLSFKEELANELALAGNQSLLEVVEALLGSPAIKKGIWQTLKIVEELIEIIGYNPKNIVVEMARENQRTNRSKPRLKALEEALKSFDSPLLKEQPVDNQALQKDRLYLYYLQNGKDMYTGEALDIDRLSEYDIDHIIPRSFIVDNSIDNKVLVSSKENRLKMDDVPDQKVVIRMRRYWEKLLRANLISERKFAYLTKLELTPEDKARFIQRQLVETRQITKHVAAILDQYFNQPEESKNKGIRIITLKSSLVSQFRKTFGINKVREINNHHHAHDAYLNGVVAIALLKKYPKLEPEFVYGNYTKFNLATENKATAKKEFYSNILRFFEKEEYSYDENGEIFWDKARHIPQIKKVISSHQVNIVKKVEVQTGGFYKETVNPKGKPDKLIQRKAGWDVSKYGGFGSPVVAYAVAFIYEKGKARKKAKAIEGITIMKQSLFEQDPIGFLSNKGYSNVTKFIKLSKYTLYELENGRRRMVASHKEAQKANSFILPEKLVTLLYHAQHYDEIAHKESFDYVNDHLSEFREILDQVIDFSNRYTIAAKNTEKIAELFEQNQESTVQSLSQSFINLMQLNAMGAPADFKFFDVIIPRKRYPSLTEIWESTIIYQSITGLRETRTRMATLWDGEQ

SEQ ID NO: 200 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 201 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 202 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSTPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 203 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 204 - protein, 1339 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKIKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 205 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 206 - protein, 1337 aa, Enterococcus faecalis
MKKDYVIGLDIGSNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQLYNAKSKEKKVQIITLKASLTSQFRSIFGLYKVREVNDYHHGQDAYLNCVVATTLLKVYPNLAPEFVYGEYPKFQTFKENKATAKTIIYTNLMRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 207 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEKFQQFMIIYNQTFVNGEGRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSYAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 208 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKAMAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPERLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 209 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQNEKPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLMRFFTEVEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTKFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFETNQTADVKEIAASFIQLMQFNAMGAPSTFKFFQKDIERARYTSIKEIFDATIIYQSTTGLYETRRKVVD

SEQ ID NO: 210 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 211 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 212 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 213 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 214 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 215 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 216 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 217 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 218 - protein, 1336 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDDKVLVASKQNQKKRDDVPKKQIVNEQRIFWNQLKEAKLISTKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 219 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMEQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 220 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKGDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLFYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTKAIEGITIMEQAAFEKDPTTFLKDKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 221 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 222 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPNKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKDKGFPHVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 223 - protein, 1330 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 224 - protein, 1330 aa, Enterococcus mundtii
MEKEYTIGLDIGTNSVGWAVLTDDYRLVARKMSIQGDSNRKKIKKNFWGARLFEEGKTAQFRRIKRTNRRRIARRRQRVLALQDIFAEEIHKKDPNFFARLEEGDRVEADKRFAKFPVFATLSEEKNYHRQYPTIYHLRHDLANSKEQADIRLVYLAIAHCLKYRGHFLFEGELDTENTSVTENYQQFLQAYQQFFPEPIGDLDDAVPILTERLSKAKRVEKVLAYYPSEKSTGNFAQFLKLMVGNQANFKKTFDLEEEMKLNFTRDCYEEDLNELLEKTSDDYAELFLKAKGVYDAILLSQILSKSDDETKAKLSANMKLRFEEHQRDLKQLKELVRRDLPKKYDDFFKNRSKNGYAGYVKGKATQEDFYKFLRTELAGLEESQSIMEKIDLEIYLLKQRTFANGVIPHQIHLVEMREIMDRQKRFYPFLKGAQGKIEKLLTFRIPYYVGPLAQEGQSPFAWIKRKSPSQITPWNFAEVVDKENSAIEFIERMTNQDTYLPKEKVLPKQSLIYQRFMIFNELTKVSYTDERGKSHYFSSEQKRKIFNELFKQHPRVTEKQLRKFLELNEQIDSTEIKGIETSFNASYSTYHDLLKLSDQMDTLLDDPDMTTMFEEIIKILTIFEDREMIREQLKPYETVLGLPAIKKLAKKHYTGWGRLSEKMIQGMREKQSRKTILDYLIDDDDFPCNRNRNFMQLINDDHLSFKETIANELIMSDSNVLLDQVKAIPGSPAVKKGIWQSIKIVEEIIGIIGKAPKNIVIEMARENQRTSRSRPRLKALEEALKNIDSPLLKDYPTDNQALQKDRLYLYYLQNGKDMYTGEPLEIHRLSEYDIDHIIPRSFIVDNSLDNKVLVSSKVNRGKLDNAPDPLVVKRMRSHWEKLHQAKLISDKKLANLTKQNLTEADKARFIQRQLVETRQITKHVANLLHQHFNLPEEVSATEKTSIITLKSTLTSQFRQMFDIYKVREINHHHHAHDAYLNGVVAMTLLKKYPKLAPEFVYGSYIKGDINQINKATAKKEFYSNIMKFFESEEIICDEQGEVIWNKKRDLSTIKKTIGAHQVNIVKKVEKQKGGFYKETINSKANPEKLIPRKASLDPLKYGGYGSPLVAYTVIFIFEKGKQKKVTKGIEGITVMEQLRFEQDPREFLKTKGYEGVKQWLILPKYILFEAQGGYRRMIASHQETQKANSLILPENLVTLLYHARHYDEINHKVSFDYVNAHKEGFNDIFDFISDFGVRYILAPQHLEKIKVAYEKNKEVDLKEMIDAILSLLKFTLFGASVEFKFFDIKILKRYKSLTDIWEATIIYQSVTGLYERRVEVRKLWDGERL

SEQ ID NO: 225 - protein, 1334 aa, Enterococcus phoeniculicola
MKKEYTIGLDIGTNSVGWAVLTENYDLVKKKMKVYGNTETKYLKKNLWGVRLFDEGETAADRRLKRTTRRRYSRRRNRICRLQDLFTEEMNQVDANFFHRLQESFLVPDEKEFERHAIFGKMEEEVSYYREFPTIYHLRKHLADTSEQADLRLVYLALAHIVKYRGHFLIEGELNTENSSVSETFRTFIQVYNQIFRENEVPLAVPDNIEELFSEKVSRARKVEAILSVYSEEKSTGTLAQFLKLMVGNQGRFKKTFDLEEDGIIQIPKEEYEEELETLLAIIGDEYAEIFSATKSVYDAVALSGILSVTDGDTKAKLSASMVERYEAHQKDLVQFKQFIRKELPEMYAPIFRDNSVSGYAGYVENSKVVTQAEFYKYIKKAIEKVPGAEYFLEKIEQETFLDKQRTFNNGVIPHQIHLEELEAIIQKQATYYPFLADNKEEMKQLVTFRIPYYVGPLADGNSPFAWLERISSEPIRPGNLAEVVDIKKSATKFIERMTNFDTYLPTEKVLPKHSMIYEKYMVYNELTKVSYVDERGMNQRFSGEEKKQIVEELFKQSRKVTKKLLEKFLSNEFGLVDVAIKGIETSFNAGYGTYHDFLKIGITREQLDKEENSETLEEIVKILTVFEDRKMIREQLKKYTYLFDEEVLKKLERRHYTGWGRLSAKLLIGIKEKRTHKTILDYLIEDDGGKQPINRNLMQLINDSDLSFKSEIAEAQSDMNTEDLHEVVQNLAGSPAIKKGILQSLKIVDELVDIMGSLPKNIVVEMARENQTTSRGRTNSNPRMKALEEAMRNLRSNLLKEYPTDNQALQNDRLYLYYLQNGKDMYTGLDLSLHNLSSYDIDHIVPQSFTTDNSLDNRVLVSSKENRGKKDDVPSKEVVQKNITLWETLKNSNLISQKKYDNLTKGLRGGLTEDDRAHFIKRQLVETRQITKHVARILDQRFNSQKDEEGKTIRAVRVVTLKSSLTSQFRKQFAIHKVREINDYHHGHDAYLNGVVANSLLRVYPQLQPEFVYGDYPKFNAYKANKATAKKQLYTNIMKFFAEDAVIIDENGEILWDKKNIATVKKVMSYPQMNIVKKPEIQTGSFSKETIKPKGDSDKLISRKTNWSPKLYGGFDSPQVAYSVIITYEKGKKKVRAKAIVGITIMEQSLFKKDPVSLLEEKGYANPEVLIHLPKYTLYELENGRRRLLASANEAQKGNQLVLPASLVTLLYHAKQVDEDSGKSEEYVREHRAEFAEILNYVQAFSETKILANKNLQTILKLYEENKEADIKEIAESFVNLMKFSAYGAPMDFKFFGKTIPRSRYTSVGELLSATIINQSITGLYETRRKLVD

SEQ ID NO: 226 - protein, 1330 aa, Enterococcus sp. AM1
MGKEYTIGLDIGTNSVGWAVLQEDLDLVRRKMKVYGNTEKNYLKKNFWGVDLFDEGMTAKDTRLKRTTRRRYFRRRQRISYLQTFFQEEMNRIDPNFFNRLDESFLIEEDKLSERHPIFGTIEEEVAYHKNYATIYHLRKELADAEEKADLRLVYLALAHIIKYRGHFLIEGRLSTENTSTEETFKTFLQKYNQTFNPVDETISIGSIFADKVSRAKKAEGVLALFPDEKRNGTFDQFLKMIVGNQGNFKKTFELEEDAKLQFSKEEYDESLEALLGEIGDEYADVFEAAKNVYNAVELSGILTVTDNSTKAKLSASMIKRYEDHKTDLKLFKEFIRKNLPEKYHEIFNDKNTDGYAGYIDNSKKTSQEKFYKYITNLIEKIDGAEYFLKKIENEDFLRKQRTFDNGIIPHQIHLEELKAILHHQAMYYPFLQEKFSNFVDLLTFRIPYYVGPLANGNSRFSWLSRKSDEPIRPWNLAEVVDLSKSAELFIERMTNFDLYLPSEKVLPKHSMLYEKYTVYNELTKVTYKDEQGKVQNFSSEEKERIFIDLFKQHRKVTKKDLSNFLRNEYNLDDVIIDGIENKFNASFNTYHDFLKLKIDPKVLDDPANEPMFEEIVKILTIFEDRKMLREQLSKFSDRLSEKTIKDLERRHYTGWGRLSAKLINGIHDKQSNKTILDYLINDDAPKKNINRNFMQLINDNRLTFKEEIEKEQLKANSEESLIEIVQNLAGSPAIKKGIFQSLKIVDELVEIMGYAPTNIVVEMARENQTTANGRRNSRPRLKNLEKAIDDLDSEILKKHPVDNKALQKDRLYLYYLQNGKDMYTNEELDIHKLSTYDIDHIIPQSFIVDNSLDNRVLVSSSKNRGKLDDVPSKEVVKKMRAFWESLYRSGLISKKKFDNLVKAESGGLSEDDKAGFIHRQLVETRQITKNVARILHQRFNSEKDEEGNLIRKVRIITLKSALTSQFRKNYGIYKIREINDYHHAHDAYLNGVVATALLKIYPQLEPEFVYGEFHRFNAFKENKATAKKQFYSNLMEFSKSDKVIIDENGEILWNQKKIVTVKKVMNYRQMNIVKKVEIQKGGFSKESILPKGDSDKLISRKKEWDTTKYGGFDSPNVAYSVVIRYEKGKTRKLVKTIVGITIMERAAFEKNEREFLKNKGYQNPQICMKLPKYSLYEFDDGRRRLLASAKEAQKGNQMVLPAHLVTFLYHAKHCNEKPDSLKYVTEHQSGFSEIMAHVKDFAEKYTLVDKNLEKILSLYAKNMDSEVKEIAQSFVDLMQLNAFGAPADFKFFGETIPRKRYTSVNELLEATIINQSITGLYETRRRLGD

SEQ ID NO: 227 - protein, 1339 aa, Enterococcus villorum
MNKAYTLGLDIGTNSVGWAVVTDDYRLMAKKMPVHSKMEKKKIKKNFWGARLFDEGQTAEERRNKRATRRRLRRRKYRILELQKIFSEEILKKDSHFFARLDESFLIPEDKQYARFPIFPTLLEEKAYYQNYPTIYHLRQKLADSTEKADIRLVYLALAHMIKYRGHFLFEGELDTENTSVEETFKEFIDIYNEQFEEGIIFYKDIPLILTDKLSKSKKVEKILQYYPKEKTTGCLAQFLKLIVGNQGNFKQAFHLDEEVKIQISKETYEEDLEKLLRKSNEEMIDVFLQVKKVYDAILLSDILSTKMKDTKAKLSAGMIERYQNHKKDLEELKQFVRAHLHEKVTVFFKDSSKDGYAGYIDGKTTQADFYKFLKKELTGVPGSEPMLAKIDQENFLLKQRTPTNGVIPHQVHLTEFKAIIDQQKQYYPFLEKSKEKMIQLLTFRIPYYVGPLAQDKETSSFAWLERKTTEKIKPWNAKDVIDYGASATKFIQRMINYDTYLPTEKVLPKYSMLYQKYTIFNELTKVAYKDDRGIKHQFSSEEKLRIFQELFKKQRRVTKKKLQHFLSANYNIEDAEILGVDKVFNSSYATYHDFLELAKPYTEKIIELLEQPEMEEMFEDIVKIITIFEDREMVRTQLKKYQRILGEEIFKKLVKKKYTGWGRLSKRLINGIRDQKTNKTILDYLINDDDFPYNRNRNFMQLINDDHLSFKEEIAKELTLSDKQSLLEVVEAIPGSPAIKKGIWQTLKIVEELIAIIGYKPKNIVIEMARENQTTTGGKNRSKPRLKSLEEALKNFDSQLLKERPVDNQSLQKDRLYLYYLQNGKDMYTGESLDIDRLSEYDIDHIIPRSFIVDHSLDNKVLVSSKENRLKKDDVPDSKVVKRMKAYWEKLLRANLISERKFSYLTKLELTDDDKARFIQRQLVETRQITKHVAAILHQYFNQTQELEKEKDIRIITLKSSLVSQFRQVFGIHKVREINHHHHAHDAYLNAVVALALLKKYPRLAPEFVYGSFAKFHLVKENKATAKKEFYSNILKFFEKEEQFCDENGEIFWDKRKHIQQIKKVISSHQVNIVKKVEVQTGSFYKETVNTKEKPDKLIKRKNNWDVTKYGGFGSPVVAYAVVFTYEKGKNHKKAKAIEGITIMEQALFEKDPISFLIEKGYSNVNQFIKLPKYTLFELANGQRRMLASHQELQKANSFILPEKLVTLLYHANHYDEIAYKDSYDYVNEHFSNFQDILDKVIIFAEKYTSAPQKLNQIIATYEKNQEADRKIMAHSFVNLMQFNALGAPADFKFFDTTITRKRYTSLTEIWQSTIIYQSVTGLYETRRRMADLWDGVQ

SEQ ID NO: 228 - protein, 1424 aa, Expression vector pCas9
MDYKDHDGDYKDHDIDYKDDDDKMAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKKK

SEQ ID NO: 229 - protein, 1343 aa, Kandleria vitulina
MSQNNNKIYNIGLDIGDASVGWAVVDEHYNLLKRHGKHMWGSRLFTQANTAVERRSSRSTRRRYNKRRERIRLLRGIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKADKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVLAKNSLTVSKYEVLNEINKLRINDHLIKRDIKDKMLHTLFMDHKSISANAMKKWLVKNQYFSNTDDIKIEGFQKENACSTSLTPWIDFTKIFGEINNSNYELIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPEMIRNKMFGFWNKLYENKIISPKKFYSLIKSEYSDKDKERFINRQIVETRQITKHVAQIISNHYETTKVVTVRADLSHAFRERYHIYKNRDINDFHHAHDAYIATILGTYIGHRFESLDAKYIYGEYQKIFRNNKNKDKEFNKNKDGFILNSMRNLYADKDTGEVVWDPEWISRIKKCFYYKDCFVTKKLEENNGSFFNLTVRPNDEHSEKGTTIAKVPVNKLRSNVHKYGGFEGLKYSIVAIKGKKKKGKKIIDVNKLVGIPLMYKNVDDETKINYIKESEGLEEVKIIKEILKNQLIEINGGLFYVTSPTEIVNARQLILDFNCTRIIDGIYKAMKYKNYSELSQEEIMNVYDIFVEKLKLYYPTYKNIATNFENMREQFENISDEEKCEVIRQMLVVMHAGPQNGNITFDDFKLSNRLGRLNCKTISLDTTVFIADSPTGMYSKKYKL

SEQ ID NO: 230 - protein, 1344 aa, Kandleria vitulina
MSQNNNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRNQKNKGKEMKKNNDGFILNSMRNIYADKDTGEIVWDPNYIDRIKKCFYYKDCFVTKKLEENNGTFFNVTVLPNDTNSDKDNTLATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAPTEIINAKQLILNESQTKLVCEIYKAMKYKNYDNLDSEKIIDLYRLLINKMELYYPEYRKQLVKKFEDRYEQLKVISIEEKCNIIKQILATLHCNSSIGKIMYSDFKISTTIGRLNGRTISLDDISFIAESPTGMYSKKYKL

SEQ ID NO: 231 - protein, 1314 aa, Lactobacillus animalis
MLKKDYSIGLDIGTNSVGHAVVTDDYKVPTKKMKVFGDTSKKTIKKNMLGVLLFNEGQTAADTRLKRGARRRYTRRKNRLRYLQEIFAPALAKVDPNFFYRLEESSLVAEDKKYDVYPIFGKREEELLYHDTHKTIYHLRSELANNDRPADLRLVYLALAHIIKYRGNFLLEGEIDLRTTDINKVFAEFSETLNENSDENLGKLDVADIFKDNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKRMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDTYSFKETIKNAQVIEKEETLAKTVQELPGSPAIKKGILQSLEIVDEIIKVMGYKPKSIVVEMARETQKTHGTRKREDRVQQIVKNLKDANELPKKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAVVANLIMAKYPELEPEFVYGKYRKTKFKGLGKATAKNTLYANVLYFLKENEVYPFWDKARDLPTIKRYLYRAQVNKVRKAERQTGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 232 - protein, 1368 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPVDDTFFLRKKQSNLSPKDQRKLYPQTSLFNDRTDRAFYDDYPTIYHLRYKLMTEKRQFDIREIYLAMHHIVKYRGHFLNEAPVSSFKSSEINLVAHFDRLNTIFADLFSESGFQLETDKLAEVKALLLDNHQSASNRQRQALLLIYTPSTNKAVEKQNKAIATELLKAILGLKAKFNVLTGIEAEDVKTWTLTFNAENFDEEMVKLESSLDDNAHQIIESLQELYSGVLLAGIVPENQSLSQAMITKYDDHQKHLKMLKAVREALAPEDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQQQSSDAKFAWMIRKAEGQITPWNFDDKVDRQASANEFIKRMTTTDTYLLAEDVLPKQSLIYQRFEVLNELNGLKIDDQPITTELKQAIFTDLFMQKTSVTVKNIQDYLVSEKRYASRPAITGLSDENKFNSRLSTYHDLKTIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISNELLNNTEIRNELKDLSNSALSNTRLFLYFMQGGRDMYTGDSLNIDRLSTYDIDHILPQSFIKDNSLDNRVLVSQRMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWNKESGLAYLNKIYQFKKILVTREVHENSGALFNQTLYAAKDDKASGQGGKQLIPAKQDRPTALYGGYSGKTVAYMCIVRIKNKKGDLYKVCGVETSWLAQLKQLTDEDSKKAFLKQKISPQFTKVKKQKGTIVKVVEDFEVIAPHILINQRFFDNGQELTLGSATYKHNEQELILDKTAVKLLNGALPLTQSEELAEQVYDEILDQVMHYFPLYDTNQFRAKLSAGKAAFMKLPWKSQWDGNKMVQVGQQVILDRVLIGLHANAAVSDLGVLKISTPLGKMQQPSGISLSPDTQIIYQSPTGLFERRVALRDL

SEQ ID NO: 233 - protein, 1356 aa, Lactobacillus farciminis
MTKKEQPYNIGLDIGTGSVGWAVTNDNYDLLNIKKKNLWGVRLFEGAQTAKETRLNRSTRRRYRRRKNRINWLNEIFSEELANTDPSFLIRLQNSWVSKKDPDRKRDKYNLFIDNPYTDKEYYREFPTIFHLRKELIINKNKADIRLVYLALHNILKYRGNFTYEHQKFNISTLNSNLSKELIELNQQLIKYDISFPDNCDWNHISDILIGRGNATQKSSNILNNFTLDKETKKLLKEVINLILGNVAHLNTIFKTSLTKDEEKLSFSGKDIESKLDDLDSILDDDQFTVLDTANRIYSTITLNEILNGESYFSMAKVNQYENHAIDLCKLRDMWHTTKNEKAVGLSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSSEKNPFAWMERKSNGHARPWNFDEIVDREKSSNKFIRRMTVTDSYLVGEPVLPKNSLIYQRYEVLNELNNIRITENLKTNPTGSRLTVETKQHIYNELFKNYKKITVKKLTKWLIAQGYYKNPILIGLSQKDEFNSTLTTYLDMKKIFGSSFMENNKNYNQIEELIEWLTIFEDKQILNEKLHSSNYSYTSDQIKKISNMRYKGWGRLSKKILTCITTETNTPKSLQLSNYSVLDLMWTTNNNFISIISNDKYDFKNYIENHNLNKNEDQNISNLVNDIHVSPALKRGITQSIKIVQEIVKFMGHAPKYIFIEVTRETKKSEITTSRGKRIQRLQSKLLNKANGFKPQLRKYLVPNEKIQEELKKHKNDLSSERIMLYFLQNGKSLYSEESLNINKLSDYQVDHILPRTYIPDDSLENKALVLAKENQRKADDLLLNSNVIDKNLERWTYMLNNNMMGLKKFKNLTRRVITDKDKLGFIHRQLVQTSQMVKGVANILNSMYKNQGTTCIQARANLSTAFRKALSDQDDRYHFKHPELVKNRNINDFHHAQDAYLASFLGTYRLRRFPTDEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREIANRQQLILPPEHSALLRILQIPDEDPDQILAFYDKNILVEILQELITKMKKFYPFYKNEQEFLASNIENFNQATTSEKINSLEELITLLHANSTSAHLIFNNIEKKAFGRKTHGLTLNDTDFIYQSVTGLYETRIHIE

SEQ ID NO: 234 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 235 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 236 - protein, 1337 aa, Listeria innocua
MKNMKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 237 - protein, 1103 aa, Listeria innocua
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 238 - protein, 1334 aa, Listeria ivanovii
MRKPYTIGLDIGTNSVGWAVLTDQYNLVKRKMKVAGSAEKKQIKKNFWGVRLFDEGEVAAGRRMNRTTRRRIERRRNRIAYLQEIFAAEMAEVDANFFYRLEDSFYIESEKRHSRHPFFATIEEEVAYHEEYKTIYHLREKLVNSSDKADLRLVYLALAHIIKYRGNFLIEGMLDTKNTSVDEVFKQFIQTYNQIFASDIEEGSLTRLEENKEVAEILSEKLTRREKLDKILKLYTGEKSTGMFARFINLIIGSKGDFKKVFDLDEKAEIECAKDTYEEDLEALLAKIGDEYAEIFVAAKSTYNAVVLSNIITVTDTETKAKLSASMIERFDKHAKDLKRLKAFFKMQLPEKFNEVFNDIEKDGYAGYIDGKTTQEKFYKYMKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 239 - protein, 953 aa, Listeria ivanovii
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 240 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEEGALAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 241 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 242 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 243 - protein, 1334 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 244 - protein, 1334 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 245 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 246 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFILTYNQVFMSNIEEGTLAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTTLENVEGADYFITKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 247 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVNDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYTFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKRIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 248 - protein, 1334 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFDWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECENGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 249 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILARKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 250 - protein, 1337 aa, Listeria monocytogenes
MKNMKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 251 - protein, 1337 aa, Listeria monocytogenes
MKNMKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILARKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 252 - protein, 782 aa, Listeria monocytogenes
  misc_feature (722)..(722): Xaa can be any naturally occurring amino acid
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 253 - protein, 1334 aa, Listeria seeligeri
MKKPYTIGLDIGTNSVGWAALTDQYDLVKRKMKVAGNSEKKQIKKNLWGVRLVDEGKTAAHRRVNRTTRRRIERRRNRISYLQEIFTAEMFEVDANFFYRLEDSFYIESEKRQSRHPFFATIEEEVAYHENYRTIYHLREKLVNSSDKADLRLVYLALAHIIKYRGNFLIEGKLDTKNTSVDEVFKQFIKTYNQVFASDIEEGSLTRIEENNEVAKIFSEKLTKREKLDKILNLYPNEKSTDLFAQFISLIIGSKGNFKKFFNLTEKTDIECAKDSYEEDLEVLLARVGDEYAEIFVAAKNAYNAVVLSSIITVSNTETKAKLSASMIERFDKHDKDLKRMKAFFKVRLPENFNEVFNDVEKDGYAGYIEGKTKQEAFYKYMKKMLEHVEGADYFINQIEEENFLRKQRTFDNGAIPHQLHLEELEAILHQQAKYYPFLKVDYEKIKSLVTFRIPYFVGPLANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMNDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 254 - protein, 1400 aa, Plant multiplex genome editing vector pYLCRISPR/Cas9Pubi-H
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKK

SEQ ID NO: 255 - protein, 1333 aa, Roseburia hominis
MSQNIVDYCIGLDLGTGSVGWAVVDMNHRLMKRNGKHLWGSRLFSNAETAATRRSSRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDVFTQFADFNNIPYEDDEKKNLEILEILKKPLSKKAKVDEVMALISPEKEFKSAYKELVTGIAGNKMNVTKMILCESIKQGDSEIKLKFSDSNYDDQFSEVENDLGEYVEFIDSLHNIYSWVELQTIMGATHTDNASISEAMVSRYNKHHEDLQLLKKCIKDNVPKKYFDMFRNDSEKVKGYYNYINRPNKAPVDEFYKFVKKCIEKVDTPEAKQILHDIELENFLLKQNSRTNGSVPYQMQLDEMIKIIDNQAKYYPVLKEKREQLLSILTFRIPYYFGPLNETSEHAWIKRLEGKENQRILPWNYQDTVDVDATAEGFIKRMRSYCTYFPDEEVLPKNSLIVSKYEVYNELNKIRVDDKLLEVDVKNDIYNELFMKNKTVTEKKLKNWLVNNQCCRKDAEIKGFQKENQFSTSLTPWIDFTNIFGKIDQSNFDLIEKIIYDLTVFEDKKIMKRRLKKKYALPDDKIKQILKLKYKDWSRLSKKLLDGIVADNRFGSSVTVLDVLEMSRLNLMEIINDKELGYAQMIEEASSCPKDGKFTYEEVAKLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVLPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKKWKDGFVINSMNYPYEVDGKLIWNPDLINEIKKCFYYKDCYCTTKLDQKSGQMFNLTVLPNDAHSAKGTTEAVIPVNKNRKDVNKYGGFSGLQYVIAAIEGTKKKGKKLVKVRKLSGIPLYLKQADIKEQIEYVEKEEKLSDVKIIKNNIPLNQLIEIDGRQYLLTSPTECVNAMQLVLNEEQCKLIADIYNAIYKQDFDGLDNMLMIQLYLQLIDKLKTLYPIYMGIVEKFEKLTEDFVSISKEEKANVIKQMLIIMHKGPQNGNIIYDDFNVGKRIGRLNGRTFYLDNIEFISQSPTGIYTKKYKL

SEQ ID NO: 256 - protein, 1335 aa, Sharpea azabuensis
MAKNKDIRYSIGLDIGTNSVGWAVMDEHYELLKKGNHHMWGSRLFDAAEPAATRRASRSIRRRYNKRRERIRLLRDLLGDMVMEVDPTFFIRLLNVSFLDEEDKQKNLGNDYKDNYNLFIEKDFNDKTYYDKYPTIYHLRKELCENKEKADPRLIYLALHHIVKYRGNFLYEGQSFTMDNSDIEERLNSAIEKFMSINEFDNRIVESDINSMIAVLSKIYQRSKKADDLLKIMNPTKEEKAAYKEFTKALVGLKFNISKMILAQEVKKGDTDIVLEFSNANYDSTIDELQSELGEYIEFIEMLHNIYSWVELQAILGATHTDNPSISAAMVERYEEHKKDLRVLKKVIREELPDKYNEVFRKDNRKLHNYLGYIKYPKDTPVEEFYKYIKGLLAKVDTDEAREILERIDLEKFMLKQNSRTNGSIPYQMQKDEMIQIIDNQSVYYPQLKENRDKLISILEFRIPYYFGPLNAHSEFAWIKKFEDKQKERILPWNYDQIVDIDATAEGFIERMKNTGTYFPDEPVMAKNSLTVSKFEVLNELNKIRINGKLIAVETKKELLSDLFMKNKTITDKKLKDWLVTHQYYDINEELKIEGYQKDLQFSTSLAPWIDFTKIFGEINASNYQLIEKIIYDISIFEDKKILKRRLKKVYQLDDLLVDKILKLNYTGWSRLSEKLLTGMTADNEFGSKATVLFVLENSNKNLMEIINDEKLGYKQIIEESNMQDIEGPFKYDEVKKLAGSPAIKRGIWQALLVVREITKFMKHEPSHIYIEFAREEQEKVRKESKIAKLQKIYENLNLQTKEDQQVYESLKKEDAKKRMETDALYLYYLQMGKSMYSGKPLDIDKLSTYQIDHILPQSLIKDDSFDNRVLVLPEENQWKLDSETVPFEIRNKMIGFWQMLHENGLMSNKKFFSLIRTDFSDKDKERFINRQLVETRQIIKNVAVIINDHYTNTNIVTVRAELSHQFRERYKIYKNRDINDFHHAHDAYIACIVGQFMHQNFEHLDAKIIYGQYKKNYKKDVKHHNNYGFILNSMNHLQSDIDTGEVMWDPAKIGKIKSCFYYKDVYVTKKLEQNSGTLFNVTVLPNDAHSEKGITAATVPLNKYRADVHKYGGFGNVQSIIVAIEGKKKKGKKLIDVRKLTSIPLHLKNAPVEEQLSYIASPEHEDLIDVRIVKEILKNQLIEIDGGLYYVTSPTEYVTARQLSLNEQSCKLISEIYAAMLKKRYEYLDEEEIFDLYLQLLQKMDTLYPAYKGIAKRFFDRAEDFKNIDVVEKCDVIKQILIIMHAGPMNGNIMYDDFKFTNRIGRFTHKNIDLNKTTFISTSVTGLFSKKYKL

SEQ ID NO: 257 - protein, 1417 aa, Artificial Sequence
  Synthetic polypeptide
MDYKDDDDKDYKDDDDKMAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKK

SEQ ID NO: 258 - protein, 1368 aa, Artificial Sequence; identical to SEQ ID NO: 2
  Synthetic polypeptide

SEQ ID NO: 259 - protein, 1376 aa, Artificial Sequence
  Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPPKKKRKV

SEQ ID NO: 260 - protein, 1372 aa, Artificial Sequence
  Synthetic polypeptide
GAASMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 261 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 262 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 263 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 264 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 265 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 266 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 267 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 268 - protein, 1053 aa, Streptococcus Aureus
MKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 269 - protein, 1121 aa, Streptococcus thermophilus
MSDLVLGLAIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSIGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 270 - protein, 887 aa, Natronobacterium gregoryi
MTVIDLDSTTTADELTSGHTYDISVTLTGVYDNTDEQHPRMSLAFEQDNGERRYITLWKNTTPKDVFTYDYATGSTYIFTNIDYEVKDGYENLTATYQTTVENATAQEVGTTDEDETFAGGEPLDHHLDDALNETPDDAETESDSGHVMTSFASRDQLPEWTLHTYTLTATDGAKTDTEYARRTLAYTVRQELYTDHDAAPVATDGLMLLTPEPLGETPLDLDCGVRVEADETRTLDYTTAKDRLLARELVEEGLKRSLWDDYLVRGIDEVLSKEPVLTCDEFDLHERYDLSVEVGHSGRAYLHINFRHRFVPKLTLADIDDDNIYPGLRVKTTYRPRRGHIVWGLRDECATDSLNTLGNQSVVAYHRNNQTPINTDLLDAIEAADRRVVETRRQGHGDDAVSFPQELLAVEPNTHQIKQFASDGFHQQARSKTRLSASRCSEKAQAFAERLDPVRLNGSTVEFSSEFFTGNNEQQLRLLYENGESVLTFRDGARGAHPDETFSKGIVNPPESFEVAVVLPEQQADTCKAQWDTMADLLNQAGAPPTRSETVQYDAFSSPESISLNVAGAIDPSEVDAAFVVLPPDQEGFADLASPTETYDELKKALANMGIYSQMAYFDRFRDAKIFYTRNVALGLLAAAGGVAFTTEHAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEYLATRDGGGLPRPIQIERVAGETDIETLTRQVYLLSQSHIQVHNSTARLPITTAYADQASTHATKGYLVQTGAFESNVGFL

SEQ ID NO: 271 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 272 - protein, 198 aa, Canis lupus
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 273 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 274 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 275 - protein, 429 aa, Rattus norvegicus
MGPFCLGCSHRKCYSPIRNLISQETFKFHFKNLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 276 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 277 - protein, 384 aa, Pan troglodytes
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 278 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 279 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 280 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 281 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 282 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 283 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 284 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 285 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 286 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 287 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 288 - protein, 229 aa, Rattus norvegicus [sequence omitted]

SEQ ID NO: 289 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 290 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQNQEN

SEQ ID NO: 291 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQ

SEQ ID NO: 292 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQ

SEQ ID NO: 293 - protein, 1633 aa, Escherichia coli
MGSSHHHHHHMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSPKKKRKV

SEQ ID NO: 294 - protein, 1623 aa, Artificial sequence
  Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCLLLGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSPKKKRKV

SEQ ID NO: 295 - protein, 1630 aa, Artificial sequence
  Synthetic polypeptide
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWRSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 296 - protein, 1710 aa, Artificial sequence
  Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCLLLGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSTNLSDLLEKETGKQLVIQESILMLPEEVEEVIGNKPESDILVHTAYDESTDENVMLLTSDAPEYKPWALVIQDSNGENKIKMLSGGSPKKKRKV

SEQ ID NO: 297 - protein, 1710 aa, Artificial sequence
  Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCLLLGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSTNLSDLLEKETGKQLVIQESILMLPEEVEEVIGNKPESDILVHTAYDESTDENVMLLTSDAPEYKPWALVIQDSNGENKIKMLSGGSPKKKRKV

SEQ ID NO: 298 - protein, 1679 aa, Artificial sequence
  Synthetic polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 299 - protein, 1689 aa, Artificial sequence
  Synthetic polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 300 - protein, 1655 aa, Artificial sequence
  Synthetic polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 301 - protein, 1665 aa, Artificial sequence
  Synthetic polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 302 - protein, 1665 aa, Artificial sequence
  Synthetic polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 303 - protein, 198 aa, Homo sapiens [sequence omitted]

SEQ ID NO: 304 - protein, 84 aa, Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 305 - protein, 181 aa, Erwinia tasmaniensis
MASRGVNKVILVGNLGQDPEVRYMPNGGAVANITLATSESWRDKQTGETKEKTEWHRVVLFGKLAEVAGEYLRKGSQVYIEGALQTRKWTDQAGVEKYTTEVVVNVGGTMQMLGGRSQGGGASAGGQNGGSNNGWGQPQQPQGGNQFSGGAQQQARPQQQPQQNNAPANNEPPIDFDDDIP

SEQ ID NO: 306 - protein, 209 aa, Artificial sequence
  Synthetic polypeptide
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 307 - protein, 313 aa, Artificial sequence
  Synthetic polypeptide
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQEPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 308 - protein, 150 aa, Artificial sequence
  Synthetic polypeptide
  MISC_FEATURE (6)..(150): May be absent
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 309 - protein, 150 aa, Artificial sequence
  Synthetic polypeptide
  MISC_FEATURE (6)..(150): May be absent
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 310 - protein, 16 aa, Artificial sequence
  Synthetic polypeptide
SGSETPGTSESATPES

SEQ ID NO: 311 - protein, 15 aa, Artificial Sequence
  Synthetic polypeptide
VPFLLEPDNINGKTC

SEQ ID NO: 312 - protein, 12 aa, Artificial Sequence
  Synthetic polypeptide
GSAGSAAGSGEF

SEQ ID NO: 313 - protein, 12 aa, Artificial Sequence
  Synthetic polypeptide
SIVAQLSRPDPA

SEQ ID NO: 314 - protein, 10 aa, Artificial Sequence
  Synthetic polypeptide
MKIIEQLPSA

SEQ ID NO: 315 - protein, 10 aa, Artificial Sequence
  Synthetic polypeptide
VRHKLKRVGS

SEQ ID NO: 316 - protein, 12 aa, Artificial Sequence
  Synthetic polypeptide
GHGTGSTGSGSS

SEQ ID NO: 317 - protein, 7 aa, Artificial Sequence
  Synthetic polypeptide
MSRPDPA

SEQ ID NO: 318 - protein, 12 aa, Artificial Sequence
  Synthetic polypeptide
SGSETPGTSESA

SEQ ID NO: 319 - protein, 21 aa, Artificial Sequence
  Synthetic polypeptide
SGSETPGTSESATPEGGSGGS

SEQ ID NO: 320 - protein, 4 aa, Artificial Sequence
  Synthetic polypeptide
GGSM

SEQ ID NO: 321 - protein, 1612 aa, Artificial Sequence
  Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 322 - RNA, 93 nt, S. pyogenes
guuuaagagcuaugcuggaaagccacggugaaaaaguucaacuauugccugaucggaauaaauuugaacgauacgacagucggugcuuuuuuu

SEQ ID NO: 323 - RNA, 82 nt, S. pyogenes
guuuaagagcuagaaauagcaaguuuaaauaaggcuaguccguuaucaacuugaaaaaguggcaccgagucggugcuuuuuu

SEQ ID NO: 324 - RNA, 97 nt, S. thermophilus
guuuuuguacucucaagauucaauaaucuugcagaagcuacaaagauaaggcuucaugccgaaaucaacacccugucauuuuauggcaggguguuuu

SEQ ID NO: 325 - RNA, 97 nt, S. thermophilus
guuuuagagcuguguuguuuguuaaaacaacacagcgaguuaaaauaaggcuuaguccguacucaacuugaaaagguggcaccgauucgguguuuuu

SEQ ID NO: 326 - RNA, 74 nt, C. jejuni
aagaaauuuaaaaagggacuaaaauaaagaguuugcgggacucugcgggguuacaauccccuaaaaccgcuuuu

SEQ ID NO: 327 - RNA, 95 nt, F. novicida
aucuaaaauuauaaauguaccaaauaauuaaugcucuguaaucauuuaaaaguauuuugaacggaccucuguuugacacgucugaauaacuaaaa

SEQ ID NO: 328 - RNA, 109 nt, S. thermophilus2
uguaagggacgccuuacacaguuacuuaaaucuugcagaagcuacaaagauaaggcuucaugccgaaaucaacacccugucauuuuauggcaggguguuuucguuauuu

SEQ ID NO: 329 - RNA, 110 nt, M. mobile
uguauuucgaaauacagauguacaguuaagaauacauaagaaugauacaucacuaaaaaaaggcuuuaugccguaacuacuacuuauuuucaaaauaaguaguuuuuuuu

SEQ ID NO: 330 - RNA, 92 nt, L. innocua
auuguuaguauucaaaauaacauagcaaguuaaaauaaggcuuuguccguuaucaacuuuuaauuaaguagcgcuguuucggcgcuuuuuuu

SEQ ID NO: 331 - RNA, 89 nt, S. pyogenes
guuggaaccauucaaaacagcauagcaaguuaaaauaaggcuaguccguuaucaacuugaaaaaguggcaccgagucggugcuuuuuuu

SEQ ID NO: 332 - RNA, 107 nt, S. mutans
guuggaaucauucgaaacaacacagcaaguuaaaauaaggcagugauuuuuaauccaguccguacacaacuugaaaaagugcgcaccgauucggugcuuuuuuauuu

SEQ ID NO: 333 - RNA, 96 nt, S. thermophilus
uugugguuugaaaccauucgaaacaacacagcgaguuaaaauaaggcuuaguccguacucaacuugaaaagguggcaccgauucgguguuuuuuuu

SEQ ID NO: 334 - RNA, 102 nt, N. meningitidis
acauauugucgcacugcgaaaugagaaccguugcuacaauaaggccgucugaaaagaugugccgcaacgcucugccccuuaaagcuucugcuuuaaggggca

SEQ ID NO: 335 - RNA, 110 nt, P. multocida
gcauauuguugcacugcgaaaugagagacguugcuacaauaaggcuucugaaaagaaugaccguaacgcucugccccuugugauucuuaauugcaaggggcaucguuuuu

SEQ ID NO: 336 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 337 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 338 - RNA, 82 nt, Artificial Sequence
  Synthetic polynucleotide
guuuuagagcuagaaauagcaaguuaaaauaaaggcuaguccguuaucaacuugaaaaaguggcaccgagucggugcuuuuu

SEQ ID NO: 339 - RNA, 20 nt, Artificial Sequence
  Synthetic polynucleotide
gauggcaauguugccucccc

SEQ ID NO: 340 - RNA, 20 nt, Artificial Sequence
  Synthetic polynucleotide
auggcaauguugccuccccc

SEQ ID NO: 341 - RNA, 20 nt, Artificial Sequence
  Synthetic polynucleotide
uggcaauguugccuccccca

SEQ ID NO: 342 - RNA, 20 nt, Artificial Sequence
  Synthetic polynucleotide
uguugccucccccaggaccu

SEQ ID NO: 343 - RNA, 20 nt, Artificial Sequence
  Synthetic polynucleotide
guugccucccccaggaccuc

SEQ ID NO: 344 - RNA, 20 nt, Artificial Sequence
  Synthetic polynucleotide
uugccucccccaggaccuca

SEQ ID NO: 345 - RNA, 20 nt, Artificial Sequence
  Synthetic polynucleotide
aaaaucaaaggaacccaaag

SEQ ID NO: 346 - RNA, 20 nt, Artificial Sequence
  Synthetic polynucleotide
aaaucaaaggaacccaaaga

SEQ ID NO: 347 - RNA, 20 nt, Artificial Sequence
  Synthetic polynucleotide
caaaggaacccaaagaagaa

SEQ ID NO: 348 - RNA, 20 nt, Artificial Sequence
  Synthetic polynucleotide
aaaggaacccaaagaagaaa

SEQ ID NO: 349 - RNA, 20 nt, Artificial Sequence
  Synthetic polynucleotide
ggaacccaaagaagaaaaga

SEQ ID NO: 350 - RNA, 20 nt, Artificial Sequence
  Synthetic polynucleotide
gaacccaaagaagaaaagaa

SEQ ID NO: 351 - RNA, 20 nt, Artificial Sequence
  Synthetic polynucleotide
cccaaagaagaaaagaaaga

SEQ ID NO: 352 - RNA, 20 nt, Artificial Sequence
  Synthetic polynucleotide
aggaacccaaagaagaaaag

SEQ ID NO: 353 - RNA, 20 nt, Artificial Sequence
  Synthetic polynucleotide
aacccaaagaagaaaagaaa

SEQ ID NO: 354 - RNA, 20 nt, Artificial Sequence
  Synthetic polynucleotide
gaaaaucaaaggaacccaaa

SEQ ID NO: 355 - RNA, 20 nt, Artificial Sequence
  Synthetic polynucleotide
ucaaaggaacccaaagaaga

SEQ ID NO: 356 - RNA, 20 nt, Artificial Sequence
  Synthetic polynucleotide
gaugaagaagccccaaagcc

SEQ ID NO: 357 - RNA, 20 nt, Artificial Sequence
  Synthetic polynucleotide
gaagaagccccaaagccaag

SEQ ID NO: 358 - RNA, 20 nt, Artificial Sequence
  Synthetic polynucleotide
aagaagccccaaagccaagc

SEQ ID NO: 359 - RNA, 20 nt, Artificial Sequence
  Synthetic polynucleotide
gaagccccaaagccaagcag

SEQ ID NO: 360 - RNA, 20 nt, Artificial Sequence
  Synthetic polynucleotide
cccaaagccaagcagugacu

SEQ ID NO: 361 - RNA, 20 nt, Artificial Sequence
  Synthetic polynucleotide
ccaaagccaagcagugacuu

SEQ ID NO: 362 - RNA, 20 nt, Artificial Sequence
  Synthetic polynucleotide
augaagaagccccaaagcca

SEQ ID NO: 363 - RNA, 20 nt, Artificial Sequence
  Synthetic polynucleotide
aaagccaagcagugacuugg

SEQ ID NO: 364 - RNA, 20 nt, Artificial Sequence
  Synthetic polynucleotide
ccaagcagugacuuggaagc

SEQ ID NO: 365 - RNA, 20 nt, Artificial Sequence
  Synthetic polynucleotide
aaacagcugcccuucaucua

SEQ ID NO: 366 - RNA, 20 nt, Artificial Sequence
  Synthetic polynucleotide
aacagcugcccuucaucuau

SEQ ID NO: 367 - RNA, 20 nt, Artificial Sequence
  Synthetic polynucleotide
acagcugcccuucaucuaug

SEQ ID NO: 368 - RNA, 20 nt, Artificial Sequence
  Synthetic polynucleotide
cagcugcccuucaucuaugg

SEQ ID NO: 369 - RNA, 20 nt, Artificial Sequence
  Synthetic polynucleotide
aaacagcugcccuucaucua

SEQ ID NO: 370 - RNA, 20 nt, Artificial Sequence
  Synthetic polynucleotide
uggggacauuccucccggca

SEQ ID NO: 371 - RNA, 20 nt, Artificial Sequence
  Synthetic polynucleotide
ggggacauuccucccggcau

SEQ ID NO: 372 - RNA, 20 nt, Artificial Sequence
  Synthetic polynucleotide
cauuccucccggcauggugu

SEQ ID NO: 373 - RNA, 20 nt, Artificial Sequence
  Synthetic polynucleotide
auuccucccggcaugguguc

SEQ ID NO: 374 - RNA, 20 nt, Artificial Sequence
  Synthetic polynucleotide
uuccucccggcaugguguca

SEQ ID NO: 375 - RNA, 20 nt, Artificial Sequence
  Synthetic polynucleotide
uauggggacauuccucccgg

SEQ ID NO: 376 - RNA, 20 nt, Artificial Sequence
  Synthetic polynucleotide
uggggacauuccucccggca

SEQ ID NO: 377 - RNA, 20 nt, Artificial Sequence
  Synthetic polynucleotide
cauggugucagagccccugg

SEQ ID NO: 378 - RNA, 20 nt, Artificial Sequence
  Synthetic polynucleotide
auggugucagagccccugga

SEQ ID NO: 379 - RNA, 20 nt, Artificial Sequence
  Synthetic polynucleotide
gucagagccccuggaggacu

SEQ ID NO: 380 - RNA, 20 nt, Artificial Sequence
  Synthetic polynucleotide
ucagagccccuggaggacuu

SEQ ID NO: 381 - RNA, 20 nt, Artificial Sequence
  Synthetic polynucleotide
ggacuuggaccccuacuaug

SEQ ID NO: 382 - RNA, 20 nt, Artificial Sequence
  Synthetic polynucleotide
gacuuggaccccuacuaugc

SEQ ID NO: 383 - RNA, 20 nt, Artificial Sequence
  Synthetic polynucleotide
accccuacuaugcagacaaa

SEQ ID NO: 384 - protein, 24 aa, Artificial Sequence
  Synthetic polypeptide
SGGSSGSETPGTSESATPESSGGS

SEQ ID NO: 385 - protein, 32 aa, Artificial Sequence
  Synthetic polypeptide
SGGSSGGSSGSETPGTSESATPESSGGSSGGS

SEQ ID NO: 386 - protein, 104 aa, Artificial Sequence
  Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 387 - RNA, 20 nt, Artificial Sequence
  Synthetic polynucleotide
ccccuacuaugcagacaaaa

SEQ ID NO: 388 - RNA, 20 nt, Artificial Sequence
  Synthetic polynucleotide
cccuacuaugcagacaaaaa

SEQ ID NO: 389 - RNA, 20 nt, Artificial Sequence
  Synthetic polynucleotide
gaccccuacuaugcagacaa

SEQ ID NO: 390 - RNA, 20 nt, Artificial Sequence
  Synthetic polynucleotide
ccccuacuaugcagacaaaa

SEQ ID NO: 391 - RNA, 20 nt, Artificial Sequence
  Synthetic polynucleotide
cuuucuccuuucaguccucu

SEQ ID NO: 392 - RNA, 20 nt, Artificial Sequence
  Synthetic polynucleotide
uuucuccuuucaguccucua

SEQ ID NO: 393 - RNA, 20 nt, Artificial Sequence
  Synthetic polynucleotide
ucuccuuucaguccucuaag

SEQ ID NO: 394 - RNA, 20 nt, Artificial Sequence
  Synthetic polynucleotide
cuccuuucaguccucuaaga

SEQ ID NO: 395 - RNA, 20 nt, Artificial Sequence
  Synthetic polynucleotide
ucuccuuucaguccucuaag

SEQ ID NO: 396 - RNA, 20 nt, Artificial Sequence
  Synthetic polynucleotide
gcuuucuccuuucaguccuc

SEQ ID NO: 397 - RNA, 20 nt, Artificial Sequence
  Synthetic polynucleotide
uucuccuuucaguccucuaa

SEQ ID NO: 398 - RNA, 20 nt, Artificial Sequence
  Synthetic polynucleotide
ccucuaagaagaauaucuau

SEQ ID NO: 399 - RNA, 20 nt, Artificial Sequence
  Synthetic polynucleotide
agugcacaugaugagcaugc

SEQ ID NO: 400 - RNA, 20 nt, Artificial Sequence
  Synthetic polynucleotide
gucagaauagugcacaugau

SEQ ID NO: 401 - RNA, 20 nt, Artificial Sequence
  Synthetic polynucleotide
cacaugaugagcaugcugaa

SEQ ID NO: 402 - RNA, 20 nt, Artificial Sequence
  Synthetic polynucleotide
uagugcacaugaugagcaug

SEQ ID NO: 403 - RNA, 20 nt, Artificial Sequence
  Synthetic polynucleotide
aauaugcaguuugucagaau

SEQ ID NO: 404 - RNA, 20 nt, Artificial Sequence
  Synthetic polynucleotide
aaauaugcaguuugucagaa

SEQ ID NO: 405 - RNA, 20 nt, Artificial Sequence
  Synthetic polynucleotide
ucauaaauaugcaguuuguc

SEQ ID NO: 406 - RNA, 20 nt, Artificial Sequence
  Synthetic polynucleotide
gucauaaauaugcaguuugu

SEQ ID NO: 407 - RNA, 20 nt, Artificial Sequence
  Synthetic polynucleotide
caguuugucagaauagugca

SEQ ID NO: 408 - RNA, 20 nt, Artificial Sequence
  Synthetic polynucleotide
auaaauaugcaguuugucag

SEQ ID NO: 409 - RNA, 20 nt, Artificial Sequence
  Synthetic polynucleotide
gucauaaauaugcaguuugu

SEQ ID NO: 410 - RNA, 20 nt, Artificial Sequence
  Synthetic polynucleotide
ggucauaaauaugcaguuug

SEQ ID NO: 411 - RNA, 20 nt, Artificial Sequence
  Synthetic polynucleotide
ccaugaauaacccaccggac

SEQ ID NO: 412 - RNA, 20 nt, Artificial Sequence
  Synthetic polynucleotide
caugaauaacccaccggacu

SEQ ID NO: 413 - RNA, 20 nt, Artificial Sequence
  Synthetic polynucleotide
auaacccaccggacuggacc

SEQ ID NO: 414 - RNA, 20 nt, Artificial Sequence
  Synthetic polynucleotide
accggacuggaccaaaaaug

SEQ ID NO: 415 - RNA, 20 nt, Artificial Sequence
  Synthetic polynucleotide
aaaguauauauuccaguaaa

SEQ ID NO: 416 - RNA, 20 nt, Artificial Sequence
  Synthetic polynucleotide
ucaaaaguauauauuccagu

SEQ ID NO: 417 - RNA, 20 nt, Artificial Sequence
  Synthetic polynucleotide
cuacacagaagccucuugca

SEQ ID NO: 418 - RNA, 20 nt, Artificial Sequence
  Synthetic polynucleotide
ccuacacagaagccucuugc

SEQ ID NO: 419 - RNA, 20 nt, Artificial Sequence
  Synthetic polynucleotide
aagugaauucuccuacacag

SEQ ID NO: 420 - RNA, 20 nt, Artificial Sequence
  Synthetic polynucleotide
aaaagugaauucuccuacac

SEQ ID NO: 421 - RNA, 20 nt, Artificial Sequence
  Synthetic polynucleotide
ccuacacagaagccucuugc

SEQ ID NO: 422 - RNA, 20 nt, Artificial Sequence
  Synthetic polynucleotide
agaaaagugaauucuccuac

SEQ ID NO: 423 - RNA, 20 nt, Artificial Sequence
  Synthetic polynucleotide
uucuucgugacccguggaac

SEQ ID NO: 424 - RNA, 20 nt, Artificial Sequence
  Synthetic polynucleotide
ucgugacccguggaacuggc

SEQ ID NO: 425 - RNA, 20 nt, Artificial Sequence
  Synthetic polynucleotide
cgugacccguggaacuggcu

SEQ ID NO: 426 - RNA, 20 nt, Artificial Sequence
  Synthetic polynucleotide
uucgugacccguggaacugg

SEQ ID NO: 427 - RNA, 20 nt, Artificial Sequence
  Synthetic polynucleotide
uuucuguaaucccagguaag

SEQ ID NO: 428 - RNA, 20 nt, Artificial Sequence
  Synthetic polynucleotide
aaucccagguaagaaguaau

SEQ ID NO: 429 - RNA, 20 nt, Artificial Sequence
  Synthetic polynucleotide
aucccagguaagaaguaauu

SEQ ID NO: 430 - RNA, 20 nt, Artificial Sequence
  Synthetic polynucleotide
cccagguaagaaguaauugg

SEQ ID NO: 431 - RNA, 20 nt, Artificial Sequence
  Synthetic polynucleotide
uauuucuguaaucccaggua

SEQ ID NO: 432 - RNA, 20 nt, Artificial Sequence
  Synthetic polynucleotide
uucuguaaucccagguaaga

SEQ ID NO: 433 - RNA, 20 nt, Artificial Sequence
  Synthetic polynucleotide
guaaucccagguaagaagua

SEQ ID NO: 434 - RNA, 20 nt, Artificial Sequence
  Synthetic polynucleotide
aaucccagguaagaaguaau

SEQ ID NO: 435 - RNA, 20 nt, Artificial Sequence
  Synthetic polynucleotide
ccuacaauugucuucaggcc

SEQ ID NO: 436 - RNA, 20 nt, Artificial Sequence
  Synthetic polynucleotide
aagccccuacaauugucuuc

SEQ ID NO: 437 - RNA, 20 nt, Artificial Sequence
  Synthetic polynucleotide
aaagccccuacaauugucuu

SEQ ID NO: 438 - RNA, 20 nt, Artificial Sequence
  Synthetic polynucleotide
cuacaauugucuucaggccu

SEQ ID NO: 439 - RNA, 20 nt, Artificial Sequence
  Synthetic polynucleotide
acagaacacagucaggauca

SEQ ID NO: 440 - RNA, 20 nt, Artificial Sequence
  Synthetic polynucleotide
acucagacagaacacaguca

SEQ ID NO: 441 - RNA, 20 nt, Artificial Sequence
  Synthetic polynucleotide
cacucagacagaacacaguc

SEQ ID NO: 442 - RNA, 20 nt, Artificial Sequence
  Synthetic polynucleotide
acacucagacagaacacagu

SEQ ID NO: 443 - RNA, 20 nt, Artificial Sequence
  Synthetic polynucleotide
acacucagacagaacacagu

SEQ ID NO: 444 - RNA, 20 nt, Artificial Sequence
  Synthetic polynucleotide
caauuagugcaaacacacuc

SEQ ID NO: 445 - RNA, 20 nt, Artificial Sequence
  Synthetic polynucleotide
ccaauuagugcaaacacacu

SEQ ID NO: 446 - RNA, 20 nt, Artificial Sequence
  Synthetic polynucleotide
uucgaaaacauuuaugcuuc

SEQ ID NO: 447 - RNA, 20 nt, Artificial Sequence
  Synthetic polynucleotide
uuucgaaaacauuuaugcuu

SEQ ID NO: 448 - RNA, 20 nt, Artificial Sequence
  Synthetic polynucleotide
auuucgaaaacauuuaugcu

SEQ ID NO: 449 - RNA, 20 nt, Artificial Sequence
  Synthetic polynucleotide
ccacaaaggagagcaucuuu

SEQ ID NO: 450 - RNA, 20 nt, Artificial Sequence
  Synthetic polynucleotide
accacaaaggagagcaucuu

SEQ ID NO: 451 - RNA, 20 nt, Artificial Sequence
  Synthetic polynucleotide
ugugcugaaaccacaaagga

SEQ ID NO: 452 - RNA, 20 nt, Artificial Sequence
  Synthetic polynucleotide
aaccacaaaggagagcaucu

SEQ ID NO: 453 - RNA, 20 nt, Artificial Sequence
  Synthetic polynucleotide
acacugacuacacacgagaa

SEQ ID NO: 454 - RNA, 20 nt, Artificial Sequence
  Synthetic polynucleotide
gacacugacuacacacgaga

SEQ ID NO: 455 - RNA, 20 nt, Artificial Sequence
  Synthetic polynucleotide
cuggacacugacuacacacg

SEQ ID NO: 456 - RNA, 20 nt, Artificial Sequence
  Synthetic polynucleotide
ucuggacacugacuacacac

SEQ ID NO: 457 - RNA, 20 nt, Artificial Sequence
  Synthetic polynucleotide
ggacacugacuacacacgag

SEQ ID NO: 458 - RNA, 20 nt, Artificial Sequence
  Synthetic polynucleotide
cucuggacacugacuacaca

SEQ ID NO: 459 - RNA, 20 nt, Artificial Sequence
  Synthetic polynucleotide
cucuggacacugacuacaca

SEQ ID NO: 460 - RNA, 20 nt, Artificial Sequence
  Synthetic polynucleotide
aguguccagagggguacacc

SEQ ID NO: 461 - RNA, 20 nt, Artificial Sequence
  Synthetic polynucleotide
uguccagagggguacaccug

SEQ ID NO: 462 - RNA, 20 nt, Artificial Sequence
  Synthetic polynucleotide
uccagagggguacaccugug

SEQ ID NO: 463 - RNA, 20 nt, Artificial Sequence
  Synthetic polynucleotide
ccagagggguacaccugugu

SEQ ID NO: 464 - RNA, 20 nt, Artificial Sequence
  Synthetic polynucleotide
agguguaccccucuggacac

SEQ ID NO: 465 - RNA, 20 nt, Artificial Sequence
  Synthetic polynucleotide
ucacacagguguaccccucu

SEQ ID NO: 466 - RNA, 20 nt, Artificial Sequence
  Synthetic polynucleotide
uucacacagguguaccccuc

SEQ ID NO: 467 - RNA, 20 nt, Artificial Sequence
  Synthetic polynucleotide
auuggcagaaacccugauua

SEQ ID NO: 468 - RNA, 20 nt, Artificial Sequence
  Synthetic polynucleotide
aaacccugauuauggcuaca

SEQ ID NO: 469 - RNA, 20 nt, Artificial Sequence
  Synthetic polynucleotide
aacccugauuauggcuacac

SEQ ID NO: 470 - RNA, 20 nt, Artificial Sequence
  Synthetic polynucleotide
uacccccaaucagguaccac

SEQ ID NO: 471 - RNA, 20 nt, Artificial Sequence
  Synthetic polynucleotide
ugcagucaccacucagcauu

SEQ ID NO: 472 - RNA, 20 nt, Artificial Sequence
  Synthetic polynucleotide
cagucaccacucagcauucg

SEQ ID NO: 473 - RNA, 20 nt, Artificial Sequence
  Synthetic polynucleotide
gcucacuguuugugccccac

SEQ ID NO: 474 - RNA, 20 nt, Artificial Sequence
  Synthetic polynucleotide
uguuugugccccacagaccc

SEQ ID NO: 475 - RNA, 20 nt, Artificial Sequence
  Synthetic polynucleotide
guuugugccccacagacccc

SEQ ID NO: 476 - RNA, 20 nt, Artificial Sequence
  Synthetic polynucleotide
uuugugccccacagacccca

SEQ ID NO: 477 - RNA, 20 nt, Artificial Sequence
  Synthetic polynucleotide
uugugccccacagaccccag

SEQ ID NO: 478 - RNA, 20 nt, Artificial Sequence
  Synthetic polynucleotide
ugugccccacagaccccagg

SEQ ID NO: 479 - RNA, 20 nt, Artificial Sequence
  Synthetic polynucleotide
ugccccacagaccccaggag

SEQ ID NO: 480 - RNA, 20 nt, Artificial Sequence
  Synthetic polynucleotide
guuugugccccacagacccc

SEQ ID NO: 481 - RNA, 20 nt, Artificial Sequence
  Synthetic polynucleotide
cacagaccccaggagcgacg

SEQ ID NO: 482 - RNA, 20 nt, Artificial Sequence
  Synthetic polynucleotide
agaccccaggagcgacgcag

SEQ ID NO: 483 - RNA, 20 nt, Artificial Sequence
  Synthetic polynucleotide
acagaccccaggagcgacgc

SEQ ID NO: 484 - RNA, 20 nt, Artificial Sequence
  Synthetic polynucleotide
uagguccccaccaaugcugc

SEQ ID NO: 485 - RNA, 20 nt, Artificial Sequence
  Synthetic polynucleotide
agguccccaccaaugcugcc

SEQ ID NO: 486 - RNA, 20 nt, Artificial Sequence
  Synthetic polynucleotide
guccccaccaaugcugccgg

SEQ ID NO: 487 - RNA, 20 nt, Artificial Sequence
  Synthetic polynucleotide
ccaccaaugcugccggugaa

SEQ ID NO: 488 - RNA, 20 nt, Artificial Sequence
  Synthetic polynucleotide
aguagguccccaccaaugcu

SEQ ID NO: 489 - RNA, 20 nt, Artificial Sequence
  Synthetic polynucleotide
uagguccccaccaaugcugc

SEQ ID NO: 490 - RNA, 20 nt, Artificial Sequence
  Synthetic polynucleotide
caccaaugcugccggugaac

SEQ ID NO: 491 - RNA, 20 nt, Artificial Sequence
  Synthetic polynucleotide
accaaugcugccggugaacg

SEQ ID NO: 492 - RNA, 20 nt, Artificial Sequence
  Synthetic polynucleotide
caccaaugcugccggugaac

SEQ ID NO: 493 - RNA, 20 nt, Artificial Sequence
  Synthetic polynucleotide
accaaugcugccggugaacg

SEQ ID NO: 494 - RNA, 20 nt, Artificial Sequence
  Synthetic polynucleotide
ccggugaacgggaaaaugca

SEQ ID NO: 495 - RNA, 20 nt, Artificial Sequence
  Synthetic polynucleotide
ccaaugcugccggugaacgg

SEQ ID NO: 496 - RNA, 20 nt, Artificial Sequence
  Synthetic polynucleotide
cccucaugcuccccaaugga

SEQ ID NO: 497 - RNA, 20 nt, Artificial Sequence
  Synthetic polynucleotide
ccccaauggacagcuucugc

SEQ ID NO: 498 - RNA, 20 nt, Artificial Sequence
  Synthetic polynucleotide
cccaauggacagcuucugcc

SEQ ID NO: 499 - RNA, 20 nt, Artificial Sequence
  Synthetic polynucleotide
cccaauggacagcuucugcc

SEQ ID NO: 500 - RNA, 20 nt, Artificial Sequence
  Synthetic polynucleotide
gcuucugccagaggugauaa

SEQ ID NO: 501 - RNA, 20 nt, Artificial Sequence
  Synthetic polynucleotide
cuucugccagaggugauaau

SEQ ID NO: 502 - RNA, 20 nt, Artificial Sequence
  Synthetic polynucleotide
ugccagaggugauaauagau

SEQ ID NO: 503 - RNA, 20 nt, Artificial Sequence
  Synthetic polynucleotide
gccagaggugauaauagaua

SEQ ID NO: 504 - RNA, 20 nt, Artificial Sequence
  Synthetic polynucleotide
ggacagcuucugccagaggu

SEQ ID NO: 505 - RNA, 20 nt, Artificial Sequence
  Synthetic polynucleotide
agcuucugccagaggugaua

SEQ ID NO: 506 - RNA, 20 nt, Artificial Sequence
  Synthetic polynucleotide
augcugaaugaucccaaccu

SEQ ID NO: 507 - RNA, 20 nt, Artificial Sequence
  Synthetic polynucleotide
ugcugaaugaucccaaccuc

SEQ ID NO: 508 - RNA, 20 nt, Artificial Sequence
  Synthetic polynucleotide
ugaaugaucccaaccucaga

SEQ ID NO: 509 - RNA, 20 nt, Artificial Sequence
  Synthetic polynucleotide
gaaugaucccaaccucagac

SEQ ID NO: 510 - RNA, 20 nt, Artificial Sequence
  Synthetic polynucleotide
aaugaucccaaccucagaca

SEQ ID NO: 511 - RNA, 20 nt, Artificial Sequence
  Synthetic polynucleotide
augaucccaaccucagacag

SEQ ID NO: 512 - RNA, 20 nt, Artificial Sequence
  Synthetic polynucleotide
ugaucccaaccucagacaga

SEQ ID NO: 513 - RNA, 20 nt, Artificial Sequence
  Synthetic polynucleotide
gaucccaaccucagacagag

SEQ ID NO: 514 - RNA, 20 nt, Artificial Sequence
  Synthetic polynucleotide
cagacaaaaauguccaccuu

SEQ ID NO: 515 - RNA, 20 nt, Artificial Sequence
  Synthetic polynucleotide
gacaaaaauguccaccuugg

SEQ ID NO: 516 - RNA, 20 nt, Artificial Sequence
  Synthetic polynucleotide
aaauguccaccuugguggua

SEQ ID NO: 517 - RNA, 20 nt, Artificial Sequence
  Synthetic polynucleotide
aauguccaccuuggugguac

SEQ ID NO: 518 - RNA, 20 nt, Artificial Sequence
  Synthetic polynucleotide
cagacaaaaauguccaccuu

SEQ ID NO: 519 - RNA, 20 nt, Artificial Sequence
  Synthetic polynucleotide
aaaauguccaccuugguggu

SEQ ID NO: 520 - RNA, 20 nt, Artificial Sequence
  Synthetic polynucleotide
ccagacaaaaauguccaccu

SEQ ID NO: 521 - RNA, 20 nt, Artificial Sequence
  Synthetic polynucleotide
gaauugcucuccauauugga

SEQ ID NO: 522 - RNA, 20 nt, Artificial Sequence
  Synthetic polynucleotide
uccauauuggauaaaauuca

SEQ ID NO: 523 - RNA, 20 nt, Artificial Sequence
  Synthetic polynucleotide
auuguaauggauccuuuugu

SEQ ID NO: 524 - RNA, 20 nt, Artificial Sequence
  Synthetic polynucleotide
uuauuguaauggauccuuuu

SEQ ID NO: 525 - RNA, 20 nt, Artificial Sequence
  Synthetic polynucleotide
auggauccuuuuguagaucu

SEQ ID NO: 526 - RNA, 20 nt, Artificial Sequence
  Synthetic polynucleotide
cuaugcaaaugguaauugca

SEQ ID NO: 527 - RNA, 20 nt, Artificial Sequence
  Synthetic polynucleotide
acuaugcaaaugguaauugc

SEQ ID NO: 528 - RNA, 20 nt, Artificial Sequence
  Synthetic polynucleotide
aacuaugcaaaugguaauug

SEQ ID NO: 529 - RNA, 20 nt, Artificial Sequence
  Synthetic polynucleotide
auggaacaccacccaaugac

SEQ ID NO: 530 - RNA, 20 nt, Artificial Sequence
  Synthetic polynucleotide
uggaacaccacccaaugacu

SEQ ID NO: 531 - RNA, 20 nt, Artificial Sequence
  Synthetic polynucleotide
ggaacaccacccaaugacug

SEQ ID NO: 532 - RNA, 20 nt, Artificial Sequence
  Synthetic polynucleotide
gaacaccacccaaugacuga

SEQ ID NO: 533 - RNA, 20 nt, Artificial Sequence
  Synthetic polynucleotide
ggaacaccacccaaugacug

SEQ ID NO: 534 - RNA, 20 nt, Artificial Sequence
  Synthetic polynucleotide
acccaaugacugaggaauuc

SEQ ID NO: 535 - RNA, 20 nt, Artificial Sequence
  Synthetic polynucleotide
uccuauagcaaguacauuuu

SEQ ID NO: 536 - RNA, 20 nt, Artificial Sequence
  Synthetic polynucleotide
cuuaccaaauuuccuauagc

SEQ ID NO: 537 - RNA, 20 nt, Artificial Sequence
  Synthetic polynucleotide
uuccuauagcaaguacauuu

SEQ ID NO: 538 - RNA, 20 nt, Artificial Sequence
  Synthetic polynucleotide
gacuuaccaaauuuccuaua

SEQ ID NO: 539 - RNA, 20 nt, Artificial Sequence
  Synthetic polynucleotide
uuccaguaaagaccuaagug

SEQ ID NO: 540 - RNA, 20 nt, Artificial Sequence
  Synthetic polynucleotide
auuccaguaaagaccuaagu

SEQ ID NO: 541 - RNA, 20 nt, Artificial Sequence
  Synthetic polynucleotide
aagauuccaguaaagaccua

SEQ ID NO: 542 - RNA, 20 nt, Artificial Sequence
  Synthetic polynucleotide
aaagauuccaguaaagaccu

SEQ ID NO: 543 - RNA, 20 nt, Artificial Sequence
  Synthetic polynucleotide
agcugcaaagauuccaguaa

SEQ ID NO: 544 - RNA, 20 nt, Artificial Sequence
  Synthetic polynucleotide
ccaguaaagaccuaagugag

SEQ ID NO: 545 - RNA, 20 nt, Artificial Sequence
  Synthetic polynucleotide
gcaaagauuccaguaaagac

SEQ ID NO: 546 - RNA, 20 nt, Artificial Sequence
  Synthetic polynucleotide
gauuccaguaaagaccuaag

SEQ ID NO: 547 - RNA, 20 nt, Artificial Sequence
  Synthetic polynucleotide
gauuccaguaaagaccuaag

SEQ ID NO: 548 - RNA, 20 nt, Artificial Sequence
  Synthetic polynucleotide
ggauccauaugaguauuucc

SEQ ID NO: 549 - RNA, 20 nt, Artificial Sequence
  Synthetic polynucleotide
uccauaugaguauuuccaag

SEQ ID NO: 550 - RNA, 20 nt, Artificial Sequence
  Synthetic polynucleotide
ccauaugaguauuuccaagu

SEQ ID NO: 551 - RNA, 20 nt, Artificial Sequence
  Synthetic polynucleotide
auggauccauaugaguauuu

SEQ ID NO: 552 - RNA, 20 nt, Artificial Sequence
  Synthetic polynucleotide
ccuuccacaucugcuagaaa

SEQ ID NO: 553 - RNA, 20 nt, Artificial Sequence
  Synthetic polynucleotide
auccuuccacaucugcuaga

SEQ ID NO: 554 - RNA, 20 nt, Artificial Sequence
  Synthetic polynucleotide
acaauccuuccacaucugcu

SEQ ID NO: 555 - RNA, 20 nt, Artificial Sequence
  Synthetic polynucleotide
gacaauccuuccacaucugc

SEQ ID NO: 556 - RNA, 20 nt, Artificial Sequence
  Synthetic polynucleotide
ugacaauccuuccacaucug

SEQ ID NO: 557 - RNA, 20 nt, Artificial Sequence
  Synthetic polynucleotide
uccuuccacaucugcuagaa

SEQ ID NO: 558 - RNA, 20 nt, Artificial Sequence
  Synthetic polynucleotide
cuggccaacauugaacaugc

SEQ ID NO: 559 - RNA, 20 nt, Artificial Sequence
  Synthetic polynucleotide
uccuggccaacauugaacau

SEQ ID NO: 560 - RNA, 20 nt, Artificial Sequence
  Synthetic polynucleotide
ccaacauugaacaugcugau

SEQ ID NO: 561 - RNA, 20 nt, Artificial Sequence
  Synthetic polynucleotide
auucuuuguagcucuuacca

SEQ ID NO: 562 - RNA, 20 nt, Artificial Sequence
  Synthetic polynucleotide
ucuugcagacacauucuuug

SEQ ID NO: 563 - RNA, 20 nt, Artificial Sequence
  Synthetic polynucleotide
ucuugcagacacauucuuug

SEQ ID NO: 564 - RNA, 20 nt, Artificial Sequence
  Synthetic polynucleotide
acagucaucauugaucuugc

SEQ ID NO: 565 - RNA, 20 nt, Artificial Sequence
  Synthetic polynucleotide
uacagucaucauugaucuug

SEQ ID NO: 566 - RNA, 20 nt, Artificial Sequence
  Synthetic polynucleotide
ugggagcguacagucaucau

SEQ ID NO: 567 - RNA, 20 nt, Artificial Sequence
  Synthetic polynucleotide
uacgcucccacgguggcaca

SEQ ID NO: 568 - RNA, 20 nt, Artificial Sequence
  Synthetic polynucleotide
cucccacgguggcacaugaa

SEQ ID NO: 569 - RNA, 20 nt, Artificial Sequence
  Synthetic polynucleotide
acagcacgcggaacacaauc

SEQ ID NO: 570 - RNA, 20 nt, Artificial Sequence
  Synthetic polynucleotide
cacagcacgcggaacacaau

SEQ ID NO: 571 - RNA, 20 nt, Artificial Sequence
  Synthetic polynucleotide
ccacucuccacacagcacgc

SEQ ID NO: 572 - RNA, 20 nt, Artificial Sequence
  Synthetic polynucleotide
uccacucuccacacagcacg

SEQ ID NO: 573 - RNA, 20 nt, Artificial Sequence
  Synthetic polynucleotide
uauccacucuccacacagca

SEQ ID NO: 574 - RNA, 20 nt, Artificial Sequence
  Synthetic polynucleotide
ucuccacacagcacgcggaa

SEQ ID NO: 575 - RNA, 20 nt, Artificial Sequence
  Synthetic polynucleotide
gaccuccauacagucccaca

SEQ ID NO: 576 - RNA, 20 nt, Artificial Sequence
  Synthetic polynucleotide
gcgaccuccauacaguccca

SEQ ID NO: 577 - RNA, 20 nt, Artificial Sequence
  Synthetic polynucleotide
aaggcacauagcuugaccag

SEQ ID NO: 578 - RNA, 20 nt, Artificial Sequence
  Synthetic polynucleotide
auaaggcacauagcuugacc

SEQ ID NO: 579 - RNA, 20 nt, Artificial Sequence
  Synthetic polynucleotide
aauaaggcacauagcuugac

SEQ ID NO: 580 - RNA, 20 nt, Artificial Sequence
  Synthetic polynucleotide
aaacaauaaggcacauagcu

SEQ ID NO: 581 - RNA, 20 nt, Artificial Sequence
  Synthetic polynucleotide
caccagguuuccaaugacca

SEQ ID NO: 582 - RNA, 20 nt, Artificial Sequence
  Synthetic polynucleotide
acccugaugcaaacaaccuc

SEQ ID NO: 583 - RNA, 20 nt, Artificial Sequence
  Synthetic polynucleotide
cccugaugcaaacaaccucc

SEQ ID NO: 584 - RNA, 20 nt, Artificial Sequence
  Synthetic polynucleotide
gacccugaugcaaacaaccu

SEQ ID NO: 585 - RNA, 20 nt, Artificial Sequence
  Synthetic polynucleotide
uccaaaaagccaaagauuuc

SEQ ID NO: 586 - RNA, 20 nt, Artificial Sequence
  Synthetic polynucleotide
ccaaaaagccaaagauuucc

SEQ ID NO: 587 - RNA, 20 nt, Artificial Sequence
  Synthetic polynucleotide
caaaaagccaaagauuucca

SEQ ID NO: 588 - RNA, 20 nt, Artificial Sequence
  Synthetic polynucleotide
aaaaagccaaagauuuccag

SEQ ID NO: 589 - RNA, 20 nt, Artificial Sequence
  Synthetic polynucleotide
aaaagccaaagauuuccagg

SEQ ID NO: 590 - RNA, 20 nt, Artificial Sequence
  Synthetic polynucleotide
aaagccaaagauuuccaggg

SEQ ID NO: 591 - RNA, 20 nt, Artificial Sequence
  Synthetic polynucleotide
ccaaagauuuccagggagau

SEQ ID NO: 592 - RNA, 20 nt, Artificial Sequence
  Synthetic polynucleotide
aaaaagccaaagauuuccag

SEQ ID NO: 593 - RNA, 20 nt, Artificial Sequence
  Synthetic polynucleotide
caaaaagccaaagauuucca

SEQ ID NO: 594 - RNA, 20 nt, Artificial Sequence
  Synthetic polynucleotide
uauucacaaucccagccuca

SEQ ID NO: 595 - RNA, 20 nt, Artificial Sequence
  Synthetic polynucleotide
auucacaaucccagccucac

SEQ ID NO: 596 - RNA, 20 nt, Artificial Sequence
  Synthetic polynucleotide
ucacaaucccagccucacag

SEQ ID NO: 597 - RNA, 20 nt, Artificial Sequence
  Synthetic polynucleotide
caaucccagccucacaguga

SEQ ID NO: 598 - RNA, 20 nt, Artificial Sequence
  Synthetic polynucleotide
aaucccagccucacagugac

SEQ ID NO: 599 - RNA, 20 nt, Artificial Sequence
  Synthetic polynucleotide
uuuauucacaaucccagccu

SEQ ID NO: 600 - RNA, 20 nt, Artificial Sequence
  Synthetic polynucleotide
cacaaucccagccucacagu

SEQ ID NO: 601 - RNA, 20 nt, Artificial Sequence
  Synthetic polynucleotide
cccagccucacagugacagu

SEQ ID NO: 602 - RNA, 20 nt, Artificial Sequence
  Synthetic polynucleotide
gugacagugccaauugcacc

SEQ ID NO: 603 - RNA, 20 nt, Artificial Sequence
  Synthetic polynucleotide
ugacagugccaauugcaccu

SEQ ID NO: 604 - RNA, 20 nt, Artificial Sequence
  Synthetic polynucleotide
gacagugccaauugcaccug

SEQ ID NO: 605 - RNA, 20 nt, Artificial Sequence
  Synthetic polynucleotide
acagugccaauugcaccugg

SEQ ID NO: 606 - RNA, 20 nt, Artificial Sequence
  Synthetic polynucleotide
ccaauugcaccuggggaauc

SEQ ID NO: 607 - RNA, 20 nt, Artificial Sequence
  Synthetic polynucleotide
gacagugccaauugcaccug

SEQ ID NO: 608 - RNA, 20 nt, Artificial Sequence
  Synthetic polynucleotide
ugccaauugcaccuggggaa

SEQ ID NO: 609 - RNA, 20 nt, Artificial Sequence
  Synthetic polynucleotide
gugacagugccaauugcacc

SEQ ID NO: 610 - RNA, 20 nt, Artificial Sequence
  Synthetic polynucleotide
ugcaccuggggaauccgauu

SEQ ID NO: 611 - RNA, 20 nt, Artificial Sequence
  Synthetic polynucleotide
gcaccuggggaauccgauuu

SEQ ID NO: 612 - RNA, 20 nt, Artificial Sequence
  Synthetic polynucleotide
caccuggggaauccgauuug

SEQ ID NO: 613 - RNA, 20 nt, Artificial Sequence
  Synthetic polynucleotide
acaguugauaacccuuugcc

SEQ ID NO: 614 - RNA, 20 nt, Artificial Sequence
  Synthetic polynucleotide
caguugauaacccuuugccu

SEQ ID NO: 615 - RNA, 20 nt, Artificial Sequence
  Synthetic polynucleotide
aguugauaacccuuugccug

SEQ ID NO: 616 - RNA, 20 nt, Artificial Sequence
  Synthetic polynucleotide
guugauaacccuuugccugg

SEQ ID NO: 617 - RNA, 20 nt, Artificial Sequence
  Synthetic polynucleotide
ugauaacccuuugccuggag

SEQ ID NO: 618 - RNA, 20 nt, Artificial Sequence
  Synthetic polynucleotide
gauaacccuuugccuggaga

SEQ ID NO: 619 - RNA, 20 nt, Artificial Sequence
  Synthetic polynucleotide
auaacccuuugccuggagaa

SEQ ID NO: 620 - RNA, 20 nt, Artificial Sequence
  Synthetic polynucleotide
uaacccuuugccuggagaag

SEQ ID NO: 621 - RNA, 20 nt, Artificial Sequence
  Synthetic polynucleotide
aacccuuugccuggagaagg

SEQ ID NO: 622 - RNA, 20 nt, Artificial Sequence
  Synthetic polynucleotide
cccuuugccuggagaaggag

SEQ ID NO: 623 - RNA, 20 nt, Artificial Sequence
  Synthetic polynucleotide
ccuuugccuggagaaggaga

SEQ ID NO: 624 - RNA, 20 nt, Artificial Sequence
  Synthetic polynucleotide
acaguugauaacccuuugcc

SEQ ID NO: 625 - RNA, 20 nt, Artificial Sequence
  Synthetic polynucleotide
caguugauaacccuuugccu

SEQ ID NO: 626 - RNA, 20 nt, Artificial Sequence
  Synthetic polynucleotide
gauaacccuuugccuggaga

SEQ ID NO: 627 - RNA, 20 nt, Artificial Sequence
  Synthetic polynucleotide
auaacccuuugccuggagaa

SEQ ID NO: 628 - RNA, 20 nt, Artificial Sequence
  Synthetic polynucleotide
acccuuugccuggagaagga

SEQ ID NO: 629 - RNA, 20 nt, Artificial Sequence
  Synthetic polynucleotide
uuugccuggagaaggagaag

SEQ ID NO: 630 - RNA, 20 nt, Artificial Sequence
  Synthetic polynucleotide
gccuggagaaggagaagaag

SEQ ID NO: 631 - RNA, 20 nt, Artificial Sequence
  Synthetic polynucleotide
ccuggagaaggagaagaagc

SEQ ID NO: 632 - RNA, 20 nt, Artificial Sequence
  Synthetic polynucleotide
gaggcugaaccuaugaauuc

SEQ ID NO: 633 - RNA, 20 nt, Artificial Sequence
  Synthetic polynucleotide
gcugaaccuaugaauuccga

SEQ ID NO: 634 - RNA, 20 nt, Artificial Sequence
  Synthetic polynucleotide
cugaaccuaugaauuccgau

SEQ ID NO: 635 - RNA, 20 nt, Artificial Sequence
  Synthetic polynucleotide
accuaugaauuccgaugagc

SEQ ID NO: 636 - RNA, 20 nt, Artificial Sequence
  Synthetic polynucleotide
ccuaugaauuccgaugagcc

SEQ ID NO: 637 - RNA, 20 nt, Artificial Sequence
  Synthetic polynucleotide
cagaggcugaaccuaugaau

SEQ ID NO: 638 - RNA, 20 nt, Artificial Sequence
  Synthetic polynucleotide
ugagccagaggccuguuuca

SEQ ID NO: 639 - RNA, 20 nt, Artificial Sequence
  Synthetic polynucleotide
gagccagaggccuguuucac

SEQ ID NO: 640 - RNA, 20 nt, Artificial Sequence
  Synthetic polynucleotide
ccagaggccuguuucacaga

SEQ ID NO: 641 - RNA, 20 nt, Artificial Sequence
  Synthetic polynucleotide
augagccagaggccuguuuc

SEQ ID NO: 642 - RNA, 20 nt, Artificial Sequence
  Synthetic polynucleotide
agccagaggccuguuucaca

SEQ ID NO: 643 - RNA, 20 nt, Artificial Sequence
  Synthetic polynucleotide
aaacaggccucuggcucauc

SEQ ID NO: 644 - RNA, 20 nt, Artificial Sequence
  Synthetic polynucleotide
gaaacaggccucuggcucau

SEQ ID NO: 645 - RNA, 20 nt, Artificial Sequence
  Synthetic polynucleotide
ccaucugugaaacaggccuc

SEQ ID NO: 646 - RNA, 20 nt, Artificial Sequence
  Synthetic polynucleotide
gaaacaggccucuggcucau

SEQ ID NO: 647 - RNA, 20 nt, Artificial Sequence
  Synthetic polynucleotide
cauacacaaccugacaagaa

SEQ ID NO: 648 - RNA, 20 nt, Artificial Sequence
  Synthetic polynucleotide
ccauacacaaccugacaaga

SEQ ID NO: 649 - RNA, 20 nt, Artificial Sequence
  Synthetic polynucleotide
ccuccauacacaaccugaca

SEQ ID NO: 650 - RNA, 20 nt, Artificial Sequence
  Synthetic polynucleotide
accuccauacacaaccugac

SEQ ID NO: 651 - RNA, 20 nt, Artificial Sequence
  Synthetic polynucleotide
aaccuccauacacaaccuga

SEQ ID NO: 652 - RNA, 20 nt, Artificial Sequence
  Synthetic polynucleotide
uuggccccauuaaaucccuu

SEQ ID NO: 653 - RNA, 20 nt, Artificial Sequence
  Synthetic polynucleotide
uggccccauuaaaucccuuc

SEQ ID NO: 654 - RNA, 20 nt, Artificial Sequence
  Synthetic polynucleotide
agaccucuaagagccuuauc

SEQ ID NO: 655 - RNA, 20 nt, Artificial Sequence
  Synthetic polynucleotide
gaccucuaagagccuuaucu

SEQ ID NO: 656 - RNA, 20 nt, Artificial Sequence
  Synthetic polynucleotide
aagaccucuaagagccuuau

SEQ ID NO: 657 - RNA, 20 nt, Artificial Sequence
  Synthetic polynucleotide
aggagcaauuccuuccauca

SEQ ID NO: 658 - RNA, 20 nt, Artificial Sequence
  Synthetic polynucleotide
gcaauuccuuccaucaugaa

SEQ ID NO: 659 - RNA, 20 nt, Artificial Sequence
  Synthetic polynucleotide
uaggagcaauuccuuccauc

SEQ ID NO: 660 - RNA, 20 nt, Artificial Sequence
  Synthetic polynucleotide
acacacaaguagcacauuca

SEQ ID NO: 661 - RNA, 20 nt, Artificial Sequence
  Synthetic polynucleotide
agacacacaaguagcacauu

SEQ ID NO: 662 - RNA, 20 nt, Artificial Sequence
  Synthetic polynucleotide
ccaugaugcugaauaucagc

SEQ ID NO: 663 - RNA, 20 nt, Artificial Sequence
  Synthetic polynucleotide
acucccaugaugcugaauau

SEQ ID NO: 664 - RNA, 20 nt, Artificial Sequence
  Synthetic polynucleotide
caaauuuacucccaugaugc

SEQ ID NO: 665 - RNA, 20 nt, Artificial Sequence
  Synthetic polynucleotide
ccaugaugcugaauaucagc

SEQ ID NO: 666 - RNA, 20 nt, Artificial Sequence
  Synthetic polynucleotide
acaaauuuacucccaugaug

SEQ ID NO: 667 - RNA, 20 nt, Artificial Sequence
  Synthetic polynucleotide
cccaugaugcugaauaucag

SEQ ID NO: 668 - RNA, 20 nt, Artificial Sequence
  Synthetic polynucleotide
aauacacucauagaacuugc

SEQ ID NO: 669 - RNA, 20 nt, Artificial Sequence
  Synthetic polynucleotide
gucacgguuuccugcaaguc

SEQ ID NO: 670 - RNA, 20 nt, Artificial Sequence
  Synthetic polynucleotide
gggucacgguuuccugcaag

SEQ ID NO: 671 - RNA, 20 nt, Artificial Sequence
  Synthetic polynucleotide
gguuuccugcaagucaaguu

SEQ ID NO: 672 - RNA, 20 nt, Artificial Sequence
  Synthetic polynucleotide
agucaaguuccaaaucguuc

SEQ ID NO: 673 - RNA, 20 nt, Artificial Sequence
  Synthetic polynucleotide
aagucaaguuccaaaucguu

SEQ ID NO: 674 - RNA, 20 nt, Artificial Sequence
  Synthetic polynucleotide
auucggaacgauuuggaacu

SEQ ID NO: 675 - RNA, 20 nt, Artificial Sequence
  Synthetic polynucleotide
caaaacauucggaacgauuu

SEQ ID NO: 676 - RNA, 20 nt, Artificial Sequence
  Synthetic polynucleotide
gcaaaacauucggaacgauu

SEQ ID NO: 677 - RNA, 20 nt, Artificial Sequence
  Synthetic polynucleotide
uaagggcaaaacauucggaa

SEQ ID NO: 678 - RNA, 20 nt, Artificial Sequence
  Synthetic polynucleotide
cauaagggcaaaacauucgg

SEQ ID NO: 679 - RNA, 20 nt, Artificial Sequence
  Synthetic polynucleotide
guagacaagcagcccaaaua

SEQ ID NO: 680 - RNA, 20 nt, Artificial Sequence
  Synthetic polynucleotide
aagcagcccaaauaugaaua

SEQ ID NO: 681 - RNA, 20 nt, Artificial Sequence
  Synthetic polynucleotide
ugacccaaagaugauaaaga

SEQ ID NO: 682 - RNA, 20 nt, Artificial Sequence
  Synthetic polynucleotide
gaaugacccaaagaugauaa

SEQ ID NO: 683 - RNA, 20 nt, Artificial Sequence
  Synthetic polynucleotide
agaaugacccaaagaugaua

SEQ ID NO: 684 - RNA, 20 nt, Artificial Sequence
  Synthetic polynucleotide
agugaagaaugacccaaaga

SEQ ID NO: 685 - RNA, 20 nt, Artificial Sequence
  Synthetic polynucleotide
cccaaagaugauaaagacga

SEQ ID NO: 686 - RNA, 20 nt, Artificial Sequence
  Synthetic polynucleotide
ugggguccaagaagccacaa

SEQ ID NO: 687 - RNA, 20 nt, Artificial Sequence
  Synthetic polynucleotide
ggguccaagaagccacaaaa

SEQ ID NO: 688 - RNA, 20 nt, Artificial Sequence
  Synthetic polynucleotide
agccacaaaagccaauuccu

SEQ ID NO: 689 - RNA, 20 nt, Artificial Sequence
  Synthetic polynucleotide
ggguccaagaagccacaaaa

SEQ ID NO: 690 - RNA, 20 nt, Artificial Sequence
  Synthetic polynucleotide
acaaaagccaauuccucgac

SEQ ID NO: 691 - RNA, 20 nt, Artificial Sequence
  Synthetic polynucleotide
caaaagccaauuccucgacc

SEQ ID NO: 692 - RNA, 20 nt, Artificial Sequence
  Synthetic polynucleotide
aaaagccaauuccucgacca

SEQ ID NO: 693 - RNA, 20 nt, Artificial Sequence
  Synthetic polynucleotide
aaagccaauuccucgaccag

SEQ ID NO: 694 - RNA, 20 nt, Artificial Sequence
  Synthetic polynucleotide
aaagccaauuccucgaccag

SEQ ID NO: 695 - RNA, 20 nt, Artificial Sequence
  Synthetic polynucleotide
caaaagccaauuccucgacc

SEQ ID NO: 696 - RNA, 20 nt, Artificial Sequence
  Synthetic polynucleotide
caaaagccaauuccucgacc

SEQ ID NO: 697 - RNA, 20 nt, Artificial Sequence
  Synthetic polynucleotide
aauuccucgaccagggguaa

SEQ ID NO: 698 - RNA, 20 nt, Artificial Sequence
  Synthetic polynucleotide
aauuccucgaccagggguaa

SEQ ID NO: 699 - RNA, 20 nt, Artificial Sequence
  Synthetic polynucleotide
guugagacagauaagaacca

SEQ ID NO: 700 - RNA, 20 nt, Artificial Sequence
  Synthetic polynucleotide
uuaccauguugagacagaua

SEQ ID NO: 701 - RNA, 20 nt, Artificial Sequence
  Synthetic polynucleotide
guuaccauguugagacagau

SEQ ID NO: 702 - RNA, 20 nt, Artificial Sequence
  Synthetic polynucleotide
agacagauaagaaccaugau

SEQ ID NO: 703 - RNA, 20 nt, Artificial Sequence
  Synthetic polynucleotide
auguugagacagauaagaac

SEQ ID NO: 704 - RNA, 20 nt, Artificial Sequence
  Synthetic polynucleotide
gguuaccauguugagacaga

SEQ ID NO: 705 - RNA, 20 nt, Artificial Sequence
  Synthetic polynucleotide
cacacauucuccagugaaaa

SEQ ID NO: 706 - RNA, 20 nt, Artificial Sequence
  Synthetic polynucleotide
gcacacauucuccagugaaa

SEQ ID NO: 707 - RNA, 20 nt, Artificial Sequence
  Synthetic polynucleotide
agcacacauucuccagugaa

SEQ ID NO: 708 - RNA, 20 nt, Artificial Sequence
  Synthetic polynucleotide
agcacacauucuccagugaa

SEQ ID NO: 709 - RNA, 20 nt, Artificial Sequence
  Synthetic polynucleotide
cacacauucuccagugaaaa

SEQ ID NO: 710 - RNA, 20 nt, Artificial Sequence
  Synthetic polynucleotide
gcacacauucuccagugaaa

SEQ ID NO: 711 - RNA, 20 nt, Artificial Sequence
  Synthetic polynucleotide
agcacacauucuccagugaa

SEQ ID NO: 712 - RNA, 20 nt, Artificial Sequence
  Synthetic polynucleotide
uuuuagcacacauucuccag

SEQ ID NO: 713 - RNA, 20 nt, Artificial Sequence
  Synthetic polynucleotide
aguuuuagcacacauucucc

SEQ ID NO: 714 - RNA, 20 nt, Artificial Sequence
  Synthetic polynucleotide
caguuuuagcacacauucuc

SEQ ID NO: 715 - RNA, 20 nt, Artificial Sequence
  Synthetic polynucleotide
agcacacauucuccagugaa

SEQ ID NO: 716 - RNA, 20 nt, Artificial Sequence
  Synthetic polynucleotide
aucaguuuuagcacacauuc

SEQ ID NO: 717 - RNA, 20 nt, Artificial Sequence
  Synthetic polynucleotide
ccauccuacagugaaguagu

SEQ ID NO: 718 - RNA, 20 nt, Artificial Sequence
  Synthetic polynucleotide
uccauccuacagugaaguag

SEQ ID NO: 719 - RNA, 20 nt, Artificial Sequence
  Synthetic polynucleotide
uauuccauccuacagugaag

SEQ ID NO: 720 - RNA, 20 nt, Artificial Sequence
  Synthetic polynucleotide
aaauauuccauccuacagug

SEQ ID NO: 721 - RNA, 20 nt, Artificial Sequence
  Synthetic polynucleotide
aaaaauauuccauccuacag

SEQ ID NO: 722 - RNA, 20 nt, Artificial Sequence
  Synthetic polynucleotide
auuccauccuacagugaagu

SEQ ID NO: 723 - RNA, 20 nt, Artificial Sequence
  Synthetic polynucleotide
aauauuccauccuacaguga

SEQ ID NO: 724 - RNA, 20 nt, Artificial Sequence
  Synthetic polynucleotide
aaaaauauuccauccuacag

SEQ ID NO: 725 - RNA, 20 nt, Artificial Sequence
  Synthetic polynucleotide
uuguguccccuacccuguuc

SEQ ID NO: 726 - RNA, 20 nt, Artificial Sequence
  Synthetic polynucleotide
uguguccccuacccuguucc

SEQ ID NO: 727 - RNA, 20 nt, Artificial Sequence
  Synthetic polynucleotide
guguccccuacccuguuccg

SEQ ID NO: 728 - RNA, 20 nt, Artificial Sequence
  Synthetic polynucleotide
guccccuacccuguuccgag

SEQ ID NO: 729 - RNA, 20 nt, Artificial Sequence
  Synthetic polynucleotide
uuuguguccccuacccuguu

SEQ ID NO: 730 - RNA, 20 nt, Artificial Sequence
  Synthetic polynucleotide
guguccccuacccuguuccg

SEQ ID NO: 731 - RNA, 20 nt, Artificial Sequence
  Synthetic polynucleotide
cuuugacuagacguaggauu

SEQ ID NO: 732 - RNA, 20 nt, Artificial Sequence
  Synthetic polynucleotide
ugcuccuuugacuagacgua

SEQ ID NO: 733 - RNA, 20 nt, Artificial Sequence
  Synthetic polynucleotide
uugcuccuuugacuagacgu

SEQ ID NO: 734 - RNA, 20 nt, Artificial Sequence
  Synthetic polynucleotide
uuugcuccuuugacuagacg

SEQ ID NO: 735 - RNA, 20 nt, Artificial Sequence
  Synthetic polynucleotide
uccccuuugcuccuuugacu

SEQ ID NO: 736 - RNA, 20 nt, Artificial Sequence
  Synthetic polynucleotide
auccccuuugcuccuuugac

SEQ ID NO: 737 - RNA, 20 nt, Artificial Sequence
  Synthetic polynucleotide
uuugcuccuuugacuagacg

SEQ ID NO: 738 - RNA, 20 nt, Artificial Sequence
  Synthetic polynucleotide
uccccuuugcuccuuugacu

SEQ ID NO: 739 - RNA, 20 nt, Artificial Sequence
  Synthetic polynucleotide
auccccuuugcuccuuugac

SEQ ID NO: 740 - RNA, 20 nt, Artificial Sequence
  Synthetic polynucleotide
gcggauccccuuugcuccuu

SEQ ID NO: 741 - RNA, 20 nt, Artificial Sequence
  Synthetic polynucleotide
cuuccugcguuguuuaacau

SEQ ID NO: 742 - RNA, 20 nt, Artificial Sequence
  Synthetic polynucleotide
cauuccaaagauggcguaga

SEQ ID NO: 743 - RNA, 20 nt, Artificial Sequence
  Synthetic polynucleotide
ggacauuccaaagauggcgu

SEQ ID NO: 744 - RNA, 20 nt, Artificial Sequence
  Synthetic polynucleotide
uggacauuccaaagauggcg

SEQ ID NO: 745 - RNA, 20 nt, Artificial Sequence
  Synthetic polynucleotide
aaguuggacauuccaaagau

SEQ ID NO: 746 - RNA, 20 nt, Artificial Sequence
  Synthetic polynucleotide
uuggacauuccaaagauggc

SEQ ID NO: 747 - RNA, 20 nt, Artificial Sequence
  Synthetic polynucleotide
aaaguuggacauuccaaaga

SEQ ID NO: 748 - RNA, 20 nt, Artificial Sequence
  Synthetic polynucleotide
gcaaaucauacuguugccaa

SEQ ID NO: 749 - RNA, 20 nt, Artificial Sequence
  Synthetic polynucleotide
ggcaaaucauacuguugcca

SEQ ID NO: 750 - RNA, 20 nt, Artificial Sequence
  Synthetic polynucleotide
aggcaaaucauacuguugcc

SEQ ID NO: 751 - RNA, 20 nt, Artificial Sequence
  Synthetic polynucleotide
uugcuagcaccuauucuuaa

SEQ ID NO: 752 - RNA, 20 nt, Artificial Sequence
  Synthetic polynucleotide
uagcaccuauucuuaacagu

SEQ ID NO: 753 - RNA, 20 nt, Artificial Sequence
  Synthetic polynucleotide
gauugcuagcaccuauucuu

SEQ ID NO: 754 - RNA, 20 nt, Artificial Sequence
  Synthetic polynucleotide
uuaacaguaagccacccgac

SEQ ID NO: 755 - RNA, 20 nt, Artificial Sequence
  Synthetic polynucleotide
aacaguaagccacccgacug

SEQ ID NO: 756 - RNA, 20 nt, Artificial Sequence
  Synthetic polynucleotide
ccacccgacugugacccaaa

SEQ ID NO: 757 - RNA, 20 nt, Artificial Sequence
  Synthetic polynucleotide
acccgacugugacccaaaaa

SEQ ID NO: 758 - RNA, 20 nt, Artificial Sequence
  Synthetic polynucleotide
agucggguggcuuacuguua

SEQ ID NO: 759 - RNA, 20 nt, Artificial Sequence
  Synthetic polynucleotide
cagucggguggcuuacuguu

SEQ ID NO: 760 - RNA, 20 nt, Artificial Sequence
  Synthetic polynucleotide
uuuuuugggucacagucggg

SEQ ID NO: 761 - RNA, 20 nt, Artificial Sequence
  Synthetic polynucleotide
cuuuuuuugggucacagucg

SEQ ID NO: 762 - RNA, 20 nt, Artificial Sequence
  Synthetic polynucleotide
acuuuuuuugggucacaguc

SEQ ID NO: 763 - RNA, 20 nt, Artificial Sequence
  Synthetic polynucleotide
cagucggguggcuuacuguu

SEQ ID NO: 764 - RNA, 20 nt, Artificial Sequence
  Synthetic polynucleotide
gaacuuuuuuugggucacag

SEQ ID NO: 765 - RNA, 20 nt, Artificial Sequence
  Synthetic polynucleotide
acagucggguggcuuacugu

SEQ ID NO: 766 - RNA, 20 nt, Artificial Sequence
  Synthetic polynucleotide
acuuuuuuugggucacaguc

SEQ ID NO: 767 - RNA, 20 nt, Artificial Sequence
  Synthetic polynucleotide
gacccaaaaaaaguucaucc

SEQ ID NO: 768 - RNA, 20 nt, Artificial Sequence
  Synthetic polynucleotide
acccaaaaaaaguucauccu

SEQ ID NO: 769 - RNA, 20 nt, Artificial Sequence
  Synthetic polynucleotide
ccaaaaaaaguucauccugg

SEQ ID NO: 770 - RNA, 20 nt, Artificial Sequence
  Synthetic polynucleotide
acccaaaaaaaguucauccu

SEQ ID NO: 771 - RNA, 20 nt, Artificial Sequence
  Synthetic polynucleotide
aaaaguucauccuggaaguu

SEQ ID NO: 772 - RNA, 20 nt, Artificial Sequence
  Synthetic polynucleotide
guucauccuggaaguucagu

SEQ ID NO: 773 - RNA, 20 nt, Artificial Sequence
  Synthetic polynucleotide
ucauccuggaaguucaguug

SEQ ID NO: 774 - RNA, 20 nt, Artificial Sequence
  Synthetic polynucleotide
cauccuggaaguucaguuga

SEQ ID NO: 775 - RNA, 20 nt, Artificial Sequence
  Synthetic polynucleotide
auccuggaaguucaguugaa

SEQ ID NO: 776 - RNA, 20 nt, Artificial Sequence
  Synthetic polynucleotide
uccuggaaguucaguugaag

SEQ ID NO: 777 - RNA, 20 nt, Artificial Sequence
  Synthetic polynucleotide
ccuggaaguucaguugaagg

SEQ ID NO: 778 - RNA, 20 nt, Artificial Sequence
  Synthetic polynucleotide
aaaaaaguucauccuggaag

SEQ ID NO: 779 - RNA, 20 nt, Artificial Sequence
  Synthetic polynucleotide
cauccuggaaguucaguuga

SEQ ID NO: 780 - RNA, 20 nt, Artificial Sequence
  Synthetic polynucleotide
uuaccacagucuccuucaac

SEQ ID NO: 781 - RNA, 20 nt, Artificial Sequence
  Synthetic polynucleotide
gacugugguaacccaucugu

SEQ ID NO: 782 - RNA, 20 nt, Artificial Sequence
  Synthetic polynucleotide
acugugguaacccaucuguu

SEQ ID NO: 783 - RNA, 20 nt, Artificial Sequence
  Synthetic polynucleotide
gacugugguaacccaucugu

SEQ ID NO: 784 - RNA, 20 nt, Artificial Sequence
  Synthetic polynucleotide
uuccaacagauggguuacca

SEQ ID NO: 785 - RNA, 20 nt, Artificial Sequence
  Synthetic polynucleotide
aguagaauauuccaacagau

SEQ ID NO: 786 - RNA, 20 nt, Artificial Sequence
  Synthetic polynucleotide
aaguagaauauuccaacaga

SEQ ID NO: 787 - RNA, 20 nt, Artificial Sequence
  Synthetic polynucleotide
uauuccaacagauggguuac

SEQ ID NO: 788 - RNA, 20 nt, Artificial Sequence
  Synthetic polynucleotide
aaaguagaauauuccaacag

SEQ ID NO: 789 - RNA, 20 nt, Artificial Sequence
  Synthetic polynucleotide
gaaaguacugaaccucugag

SEQ ID NO: 790 - RNA, 20 nt, Artificial Sequence
  Synthetic polynucleotide
aaaguacugaaccucugagu

SEQ ID NO: 791 - RNA, 20 nt, Artificial Sequence
  Synthetic polynucleotide
aaguacugaaccucugagug

SEQ ID NO: 792 - RNA, 20 nt, Artificial Sequence
  Synthetic polynucleotide
aguacugaaccucugaguga

SEQ ID NO: 793 - RNA, 20 nt, Artificial Sequence
  Synthetic polynucleotide
acugaaccucugagugagga

SEQ ID NO: 794 - RNA, 20 nt, Artificial Sequence
  Synthetic polynucleotide
ccucugagugaggaugacuu

SEQ ID NO: 795 - RNA, 20 nt, Artificial Sequence
  Synthetic polynucleotide
aaaguacugaaccucugagu

SEQ ID NO: 796 - RNA, 20 nt, Artificial Sequence
  Synthetic polynucleotide
ccucugagugaggaugacuu

SEQ ID NO: 797 - RNA, 20 nt, Artificial Sequence
  Synthetic polynucleotide
aguuugaucccgaugcgacc

SEQ ID NO: 798 - RNA, 20 nt, Artificial Sequence
  Synthetic polynucleotide
ucccgaugcgacccaguuua

SEQ ID NO: 799 - RNA, 20 nt, Artificial Sequence
  Synthetic polynucleotide
cccgaugcgacccaguuuau

SEQ ID NO: 800 - RNA, 20 nt, Artificial Sequence
  Synthetic polynucleotide
gaaguuugaucccgaugcga

SEQ ID NO: 801 - RNA, 20 nt, Artificial Sequence
  Synthetic polynucleotide
ucccgaugcgacccaguuua

SEQ ID NO: 802 - RNA, 20 nt, Artificial Sequence
  Synthetic polynucleotide
ccuggauccuccucuucuca

SEQ ID NO: 803 - RNA, 20 nt, Artificial Sequence
  Synthetic polynucleotide
ucucauagcaaaacccaaca

SEQ ID NO: 804 - RNA, 20 nt, Artificial Sequence
  Synthetic polynucleotide
uagcaaaacccaacaaaguc

SEQ ID NO: 805 - RNA, 20 nt, Artificial Sequence
  Synthetic polynucleotide
cuucucauagcaaaacccaa

SEQ ID NO: 806 - RNA, 20 nt, Artificial Sequence
  Synthetic polynucleotide
gccauggaucugcccauggu

SEQ ID NO: 807 - RNA, 20 nt, Artificial Sequence
  Synthetic polynucleotide
ccauggaucugcccaugguu

SEQ ID NO: 808 - RNA, 20 nt, Artificial Sequence
  Synthetic polynucleotide
auggaucugcccaugguuag

SEQ ID NO: 809 - RNA, 20 nt, Artificial Sequence
  Synthetic polynucleotide
uggaucugcccaugguuagu

SEQ ID NO: 810 - RNA, 20 nt, Artificial Sequence
  Synthetic polynucleotide
gaucugcccaugguuagugg

SEQ ID NO: 811 - RNA, 20 nt, Artificial Sequence
  Synthetic polynucleotide
ugcccaugguuaguggugac

SEQ ID NO: 812 - RNA, 20 nt, Artificial Sequence
  Synthetic polynucleotide
gcccaugguuaguggugacc

SEQ ID NO: 813 - RNA, 20 nt, Artificial Sequence
  Synthetic polynucleotide
uugccauggaucugcccaug

SEQ ID NO: 814 - RNA, 20 nt, Artificial Sequence
  Synthetic polynucleotide
ccauggaucugcccaugguu

SEQ ID NO: 815 - RNA, 20 nt, Artificial Sequence
  Synthetic polynucleotide
cugcccaugguuagugguga

SEQ ID NO: 816 - RNA, 20 nt, Artificial Sequence
  Synthetic polynucleotide
auggaucugcccaugguuag

SEQ ID NO: 817 - RNA, 20 nt, Artificial Sequence
  Synthetic polynucleotide
augucugcaaauccuuccaa

SEQ ID NO: 818 - RNA, 20 nt, Artificial Sequence
  Synthetic polynucleotide
aauccuuccaaaguguccua

SEQ ID NO: 819 - RNA, 20 nt, Artificial Sequence
  Synthetic polynucleotide
uucaugucugcaaauccuuc

SEQ ID NO: 820 - RNA, 20 nt, Artificial Sequence
  Synthetic polynucleotide
gaacucaaguccagaaaaaa

SEQ ID NO: 821 - RNA, 20 nt, Artificial Sequence
  Synthetic polynucleotide
aacucaaguccagaaaaaac

SEQ ID NO: 822 - RNA, 20 nt, Artificial Sequence
  Synthetic polynucleotide
agaacucaaguccagaaaaa

SEQ ID NO: 823 - RNA, 20 nt, Artificial Sequence
  Synthetic polynucleotide
ccaccaccucuccaccuuca

SEQ ID NO: 824 - RNA, 20 nt, Artificial Sequence
  Synthetic polynucleotide
accaccucuccaccuucaua

SEQ ID NO: 825 - RNA, 20 nt, Artificial Sequence
  Synthetic polynucleotide
accucuccaccuucauauga

SEQ ID NO: 826 - RNA, 20 nt, Artificial Sequence
  Synthetic polynucleotide
ccucuccaccuucauaugau

SEQ ID NO: 827 - RNA, 20 nt, Artificial Sequence
  Synthetic polynucleotide
ccaccucuccaccuucauau

SEQ ID NO: 828 - RNA, 20 nt, Artificial Sequence
  Synthetic polynucleotide
aguguaacaaagccagacaa

SEQ ID NO: 829 - RNA, 20 nt, Artificial Sequence
  Synthetic polynucleotide
guguaacaaagccagacaaa

SEQ ID NO: 830 - RNA, 20 nt, Artificial Sequence
  Synthetic polynucleotide
uguaacaaagccagacaaag

SEQ ID NO: 831 - RNA, 20 nt, Artificial Sequence
  Synthetic polynucleotide
aagccagacaaagagaaaua

SEQ ID NO: 832 - RNA, 20 nt, Artificial Sequence
  Synthetic polynucleotide
uguaacaaagccagacaaag

SEQ ID NO: 833 - RNA, 20 nt, Artificial Sequence
  Synthetic polynucleotide
aguguaacaaagccagacaa

SEQ ID NO: 834 - RNA, 20 nt, Artificial Sequence
  Synthetic polynucleotide
aaacagucucuugcccucau

SEQ ID NO: 835 - RNA, 20 nt, Artificial Sequence
  Synthetic polynucleotide
cucauugaacaacgcauugc

SEQ ID NO: 836 - RNA, 20 nt, Artificial Sequence
  Synthetic polynucleotide
auugaacaacgcauugcuga

SEQ ID NO: 837 - RNA, 20 nt, Artificial Sequence
  Synthetic polynucleotide
uugaacaacgcauugcugaa

SEQ ID NO: 838 - RNA, 20 nt, Artificial Sequence
  Synthetic polynucleotide
ugaacaacgcauugcugaaa

SEQ ID NO: 839 - RNA, 20 nt, Artificial Sequence
  Synthetic polynucleotide
cauugaacaacgcauugcug

SEQ ID NO: 840 - RNA, 20 nt, Artificial Sequence
  Synthetic polynucleotide
aaacagcugcccuucaucua

SEQ ID NO: 841 - RNA, 20 nt, Artificial Sequence
  Synthetic polynucleotide
aacagcugcccuucaucuau

SEQ ID NO: 842 - RNA, 20 nt, Artificial Sequence
  Synthetic polynucleotide
acagcugcccuucaucuaug

SEQ ID NO: 843 - RNA, 20 nt, Artificial Sequence
  Synthetic polynucleotide
cagcugcccuucaucuaugg

SEQ ID NO: 844 - RNA, 20 nt, Artificial Sequence
  Synthetic polynucleotide
aaacagcugcccuucaucua

SEQ ID NO: 845 - RNA, 20 nt, Artificial Sequence
  Synthetic polynucleotide
ccaguccgguggguuauuca

SEQ ID NO: 846 - RNA, 20 nt, Artificial Sequence
  Synthetic polynucleotide
cauuuuugguccaguccggu

SEQ ID NO: 847 - RNA, 20 nt, Artificial Sequence
  Synthetic polynucleotide
acauuuuugguccaguccgg

SEQ ID NO: 848 - RNA, 20 nt, Artificial Sequence
  Synthetic polynucleotide
guccaguccgguggguuauu

SEQ ID NO: 849 - RNA, 20 nt, Artificial Sequence
  Synthetic polynucleotide
gacauuuuugguccaguccg

SEQ ID NO: 850 - RNA, 20 nt, Artificial Sequence
  Synthetic polynucleotide
ccacgggucacgaagaaaag

SEQ ID NO: 851 - RNA, 20 nt, Artificial Sequence
  Synthetic polynucleotide
uuccacgggucacgaagaaa

SEQ ID NO: 852 - RNA, 20 nt, Artificial Sequence
  Synthetic polynucleotide
guuccacgggucacgaagaa

SEQ ID NO: 853 - RNA, 20 nt, Artificial Sequence
  Synthetic polynucleotide
gccaguuccacgggucacga

SEQ ID NO: 854 - RNA, 20 nt, Artificial Sequence
  Synthetic polynucleotide
agccaguuccacgggucacg

SEQ ID NO: 855 - RNA, 20 nt, Artificial Sequence
  Synthetic polynucleotide
ccagccaguuccacggguca

SEQ ID NO: 856 - RNA, 20 nt, Artificial Sequence
  Synthetic polynucleotide
uccacgggucacgaagaaaa

SEQ ID NO: 857 - RNA, 20 nt, Artificial Sequence
  Synthetic polynucleotide
caguuccacgggucacgaag

SEQ ID NO: 858 - RNA, 20 nt, Artificial Sequence
  Synthetic polynucleotide
cagccaguuccacgggucac

SEQ ID NO: 859 - RNA, 20 nt, Artificial Sequence
  Synthetic polynucleotide
caaaauccagccaguuccac

SEQ ID NO: 860 - RNA, 20 nt, Artificial Sequence
  Synthetic polynucleotide
acaaaauccagccaguucca

SEQ ID NO: 861 - RNA, 20 nt, Artificial Sequence
  Synthetic polynucleotide
gacaaaauccagccaguucc

SEQ ID NO: 862 - RNA, 20 nt, Artificial Sequence
  Synthetic polynucleotide
guuucagcucuucgaacuuu

SEQ ID NO: 863 - RNA, 20 nt, Artificial Sequence
  Synthetic polynucleotide
uuucagcucuucgaacuuuc

SEQ ID NO: 864 - RNA, 20 nt, Artificial Sequence
  Synthetic polynucleotide
uucagcucuucgaacuuuca

SEQ ID NO: 865 - RNA, 20 nt, Artificial Sequence
  Synthetic polynucleotide
ucuucgaacuuucagaguau

SEQ ID NO: 866 - RNA, 20 nt, Artificial Sequence
  Synthetic polynucleotide
cuucgaacuuucagaguauu

SEQ ID NO: 867 - RNA, 20 nt, Artificial Sequence
  Synthetic polynucleotide
uucgaacuuucagaguauug

SEQ ID NO: 868 - RNA, 20 nt, Artificial Sequence
  Synthetic polynucleotide
ucgaacuuucagaguauuga

SEQ ID NO: 869 - RNA, 20 nt, Artificial Sequence
  Synthetic polynucleotide
guuucagcucuucgaacuuu

SEQ ID NO: 870 - RNA, 20 nt, Artificial Sequence
  Synthetic polynucleotide
gggcuuugauccagucagug

SEQ ID NO: 871 - RNA, 20 nt, Artificial Sequence
  Synthetic polynucleotide
ggcuuugauccagucaguga

SEQ ID NO: 872 - RNA, 20 nt, Artificial Sequence
  Synthetic polynucleotide
cuuugauccagucagugaag

SEQ ID NO: 873 - RNA, 20 nt, Artificial Sequence
  Synthetic polynucleotide
cagucagugaagaagcuuuc

SEQ ID NO: 874 - RNA, 20 nt, Artificial Sequence
  Synthetic polynucleotide
uccagucagugaagaagcuu

SEQ ID NO: 875 - RNA, 20 nt, Artificial Sequence
  Synthetic polynucleotide
ggggcuuugauccagucagu

SEQ ID NO: 876 - RNA, 20 nt, Artificial Sequence
  Synthetic polynucleotide
aauuggacuacagcuguuca

SEQ ID NO: 877 - RNA, 20 nt, Artificial Sequence
  Synthetic polynucleotide
auuggacuacagcuguucau

SEQ ID NO: 878 - RNA, 20 nt, Artificial Sequence
  Synthetic polynucleotide
uuggacuacagcuguucaug

SEQ ID NO: 879 - RNA, 20 nt, Artificial Sequence
  Synthetic polynucleotide
acagcuguucaugggaaacc

SEQ ID NO: 880 - RNA, 20 nt, Artificial Sequence
  Synthetic polynucleotide
agcuguucaugggaaaccug

SEQ ID NO: 881 - RNA, 20 nt, Artificial Sequence
  Synthetic polynucleotide
aaauguuuucgaaauucacu

SEQ ID NO: 882 - RNA, 20 nt, Artificial Sequence
  Synthetic polynucleotide
cgaaauucacuugaaaauaa

SEQ ID NO: 883 - RNA, 20 nt, Artificial Sequence
  Synthetic polynucleotide
aauguuuucgaaauucacuu

SEQ ID NO: 884 - RNA, 20 nt, Artificial Sequence
  Synthetic polynucleotide
guuuucgaaauucacuugaa

SEQ ID NO: 885 - RNA, 20 nt, Artificial Sequence
  Synthetic polynucleotide
cucguguguagucagugucc

SEQ ID NO: 886 - RNA, 20 nt, Artificial Sequence
  Synthetic polynucleotide
ucguguguagucagugucca

SEQ ID NO: 887 - RNA, 20 nt, Artificial Sequence
  Synthetic polynucleotide
cguguguagucaguguccag

SEQ ID NO: 888 - RNA, 20 nt, Artificial Sequence
  Synthetic polynucleotide
guguguagucaguguccaga

SEQ ID NO: 889 - RNA, 20 nt, Artificial Sequence
  Synthetic polynucleotide
uguguagucaguguccagag

SEQ ID NO: 890 - RNA, 20 nt, Artificial Sequence
  Synthetic polynucleotide
aguguccagagggguacacc

SEQ ID NO: 891 - RNA, 20 nt, Artificial Sequence
  Synthetic polynucleotide
cguguguagucaguguccag

SEQ ID NO: 892 - RNA, 20 nt, Artificial Sequence
  Synthetic polynucleotide
cguguguagucaguguccag

SEQ ID NO: 893 - RNA, 20 nt, Artificial Sequence
  Synthetic polynucleotide
cagcugaaagugucaaagcu

SEQ ID NO: 894 - RNA, 20 nt, Artificial Sequence
  Synthetic polynucleotide
aggcccagcugaaaguguca

SEQ ID NO: 895 - RNA, 20 nt, Artificial Sequence
  Synthetic polynucleotide
gcuaagaaggcccagcugaa

SEQ ID NO: 896 - RNA, 20 nt, Artificial Sequence
  Synthetic polynucleotide
aaggcuaagaaggcccagcu

SEQ ID NO: 897 - RNA, 20 nt, Artificial Sequence
  Synthetic polynucleotide
ggcuaaugacccaagauuac

SEQ ID NO: 898 - RNA, 20 nt, Artificial Sequence
  Synthetic polynucleotide
gcuaaugacccaagauuacu

SEQ ID NO: 899 - RNA, 20 nt, Artificial Sequence
  Synthetic polynucleotide
cuaaugacccaagauuacug

SEQ ID NO: 900 - RNA, 20 nt, Artificial Sequence
  Synthetic polynucleotide
ucccaguaaucuugggucau

SEQ ID NO: 901 - RNA, 20 nt, Artificial Sequence
  Synthetic polynucleotide
aagguuuucccaguaaucuu

SEQ ID NO: 902 - RNA, 20 nt, Artificial Sequence
  Synthetic polynucleotide
aaagguuuucccaguaaucu

SEQ ID NO: 903 - RNA, 20 nt, Artificial Sequence
  Synthetic polynucleotide
uaaagguuuucccaguaauc

SEQ ID NO: 904 - RNA, 20 nt, Artificial Sequence
  Synthetic polynucleotide
uuuaccaacaggugaguacc

SEQ ID NO: 905 - RNA, 20 nt, Artificial Sequence
  Synthetic polynucleotide
uuaccaacaggugaguacca

SEQ ID NO: 906 - RNA, 20 nt, Artificial Sequence
  Synthetic polynucleotide
uaccaacaggugaguaccaa

SEQ ID NO: 907 - RNA, 20 nt, Artificial Sequence
  Synthetic polynucleotide
accaacaggugaguaccaag

SEQ ID NO: 908 - RNA, 20 nt, Artificial Sequence
  Synthetic polynucleotide
uuaccaacaggugaguacca

SEQ ID NO: 909 - RNA, 20 nt, Artificial Sequence
  Synthetic polynucleotide
uuuaccaacaggugaguacc

SEQ ID NO: 910 - RNA, 20 nt, Artificial Sequence
  Synthetic polynucleotide
uuaccaacaggugaguacca

SEQ ID NO: 911 - RNA, 20 nt, Artificial Sequence
  Synthetic polynucleotide
uaccaacaggugaguaccaa

SEQ ID NO: 912 - RNA, 20 nt, Artificial Sequence
  Synthetic polynucleotide
accaacaggugaguaccaag

SEQ ID NO: 913 - RNA, 20 nt, Artificial Sequence
  Synthetic polynucleotide
uuaccaacaggugaguacca

SEQ ID NO: 914 - RNA, 20 nt, Artificial Sequence
  Synthetic polynucleotide
gaacagaaccaggcaaacau

SEQ ID NO: 915 - RNA, 20 nt, Artificial Sequence
  Synthetic polynucleotide
acagaaccaggcaaacauug

SEQ ID NO: 916 - RNA, 20 nt, Artificial Sequence
  Synthetic polynucleotide
cagaaccaggcaaacauuga

SEQ ID NO: 917 - RNA, 20 nt, Artificial Sequence
  Synthetic polynucleotide
aacagaaccaggcaaacauu

SEQ ID NO: 918 - RNA, 20 nt, Artificial Sequence
  Synthetic polynucleotide
gaaccaggcaaacauugaag

SEQ ID NO: 919 - RNA, 20 nt, Artificial Sequence
  Synthetic polynucleotide
agaagcuaaacagaaagaau

SEQ ID NO: 920 - RNA, 20 nt, Artificial Sequence
  Synthetic polynucleotide
gaagcuaaacagaaagaauu

SEQ ID NO: 921 - RNA, 20 nt, Artificial Sequence
  Synthetic polynucleotide
agaaagaauuagaauuucaa

SEQ ID NO: 922 - RNA, 20 nt, Artificial Sequence
  Synthetic polynucleotide
agaagcuaaacagaaagaau

SEQ ID NO: 923 - RNA, 20 nt, Artificial Sequence
  Synthetic polynucleotide
cagaaagaauuagaauuuca

SEQ ID NO: 924 - RNA, 20 nt, Artificial Sequence
  Synthetic polynucleotide
aagaagcuaaacagaaagaa

SEQ ID NO: 925 - RNA, 20 nt, Artificial Sequence
  Synthetic polynucleotide
auuagaauuucaacagaugu

SEQ ID NO: 926 - RNA, 20 nt, Artificial Sequence
  Synthetic polynucleotide
uuagaauuucaacagauguu

SEQ ID NO: 927 - RNA, 20 nt, Artificial Sequence
  Synthetic polynucleotide
uuagaauuucaacagauguu

SEQ ID NO: 928 - RNA, 20 nt, Artificial Sequence
  Synthetic polynucleotide
aaaaaagagcaagaagaagc

SEQ ID NO: 929 - RNA, 20 nt, Artificial Sequence
  Synthetic polynucleotide
aaaaagagcaagaagaagcu

SEQ ID NO: 930 - RNA, 20 nt, Artificial Sequence
  Synthetic polynucleotide
aaaagagcaagaagaagcug

SEQ ID NO: 931 - RNA, 20 nt, Artificial Sequence
  Synthetic polynucleotide
aaaaaagagcaagaagaagc

SEQ ID NO: 932 - RNA, 20 nt, Artificial Sequence
  Synthetic polynucleotide
aagaaucaaaagaagcucuc

SEQ ID NO: 933 - RNA, 20 nt, Artificial Sequence
  Synthetic polynucleotide
agaaucaaaagaagcucucc

SEQ ID NO: 934 - RNA, 20 nt, Artificial Sequence
  Synthetic polynucleotide
aaucaaaagaagcucuccag

SEQ ID NO: 935 - RNA, 20 nt, Artificial Sequence
  Synthetic polynucleotide
aucaaaagaagcucuccagu

SEQ ID NO: 936 - RNA, 20 nt, Artificial Sequence
  Synthetic polynucleotide
ucaaaagaagcucuccagug

SEQ ID NO: 937 - RNA, 20 nt, Artificial Sequence
  Synthetic polynucleotide
caaaagaagcucuccagugg

SEQ ID NO: 938 - RNA, 20 nt, Artificial Sequence
  Synthetic polynucleotide
aaaagaagcucuccagugga

SEQ ID NO: 939 - RNA, 20 nt, Artificial Sequence
  Synthetic polynucleotide
aaaagaaucaaaagaagcuc

SEQ ID NO: 940 - RNA, 20 nt, Artificial Sequence
  Synthetic polynucleotide
aaucaaaagaagcucuccag

SEQ ID NO: 941 - RNA, 20 nt, Artificial Sequence
  Synthetic polynucleotide
gaagggcauaggcgagcaca

SEQ ID NO: 942 - RNA, 20 nt, Artificial Sequence
  Synthetic polynucleotide
ggcauaggcgagcacaugaa

SEQ ID NO: 943 - RNA, 20 nt, Artificial Sequence
  Synthetic polynucleotide
gcauaggcgagcacaugaaa

SEQ ID NO: 944 - RNA, 20 nt, Artificial Sequence
  Synthetic polynucleotide
cauaggcgagcacaugaaaa

SEQ ID NO: 945 - RNA, 20 nt, Artificial Sequence
  Synthetic polynucleotide
auaggcgagcacaugaaaag

SEQ ID NO: 946 - RNA, 20 nt, Artificial Sequence
  Synthetic polynucleotide
gcauaggcgagcacaugaaa

SEQ ID NO: 947 - RNA, 20 nt, Artificial Sequence
  Synthetic polynucleotide
uacccccaaucagguaccac

SEQ ID NO: 948 - RNA, 20 nt, Artificial Sequence
  Synthetic polynucleotide
aucagguaccacccaaauug

SEQ ID NO: 949 - RNA, 20 nt, Artificial Sequence
  Synthetic polynucleotide
uuuucugcaaggcgaagcag

SEQ ID NO: 950 - RNA, 20 nt, Artificial Sequence
  Synthetic polynucleotide
uuucugcaaggcgaagcagc

SEQ ID NO: 951 - RNA, 20 nt, Artificial Sequence
  Synthetic polynucleotide
gcaaggcgaagcagcagaac

SEQ ID NO: 952 - RNA, 20 nt, Artificial Sequence
  Synthetic polynucleotide
cugcaaggcgaagcagcaga

SEQ ID NO: 953 - RNA, 20 nt, Artificial Sequence
  Synthetic polynucleotide
gaagcagcagaacaagucuu

SEQ ID NO: 954 - RNA, 20 nt, Artificial Sequence
  Synthetic polynucleotide
guuugugccccacagacccc

SEQ ID NO: 955 - RNA, 20 nt, Artificial Sequence
  Synthetic polynucleotide
uuugugccccacagacccca

SEQ ID NO: 956 - RNA, 20 nt, Artificial Sequence
  Synthetic polynucleotide
uugugccccacagaccccag

SEQ ID NO: 957 - RNA, 20 nt, Artificial Sequence
  Synthetic polynucleotide
ugugccccacagaccccagg

SEQ ID NO: 958 - RNA, 20 nt, Artificial Sequence
  Synthetic polynucleotide
ugccccacagaccccaggag

SEQ ID NO: 959 - RNA, 20 nt, Artificial Sequence
  Synthetic polynucleotide
cacagaccccaggagcgacg

SEQ ID NO: 960 - RNA, 20 nt, Artificial Sequence
  Synthetic polynucleotide
agaccccaggagcgacgcag

SEQ ID NO: 961 - RNA, 20 nt, Artificial Sequence
  Synthetic polynucleotide
acagaccccaggagcgacgc

SEQ ID NO: 962 - RNA, 20 nt, Artificial Sequence
  Synthetic polynucleotide
guuugugccccacagacccc

SEQ ID NO: 963 - RNA, 20 nt, Artificial Sequence
  Synthetic polynucleotide
agaccccaggagcgacgcag

SEQ ID NO: 964 - RNA, 20 nt, Artificial Sequence
  Synthetic polynucleotide
gagcgacgcagcaguaacau

SEQ ID NO: 965 - RNA, 20 nt, Artificial Sequence
  Synthetic polynucleotide
aguaacaucagccaagccag

SEQ ID NO: 966 - RNA, 20 nt, Artificial Sequence
  Synthetic polynucleotide
guaacaucagccaagccagu

SEQ ID NO: 967 - RNA, 20 nt, Artificial Sequence
  Synthetic polynucleotide
caguaacaucagccaagcca

SEQ ID NO: 968 - RNA, 20 nt, Artificial Sequence
  Synthetic polynucleotide
agccaagccaguaggucccc

SEQ ID NO: 969 - RNA, 20 nt, Artificial Sequence
  Synthetic polynucleotide
ccccaauggacagcuucugc

SEQ ID NO: 970 - RNA, 20 nt, Artificial Sequence
  Synthetic polynucleotide
cccaauggacagcuucugcc

SEQ ID NO: 971 - RNA, 20 nt, Artificial Sequence
  Synthetic polynucleotide
ccaauggacagcuucugcca

SEQ ID NO: 972 - RNA, 20 nt, Artificial Sequence
  Synthetic polynucleotide
caauggacagcuucugccag

SEQ ID NO: 973 - RNA, 20 nt, Artificial Sequence
  Synthetic polynucleotide
aauggacagcuucugccaga

SEQ ID NO: 974 - RNA, 20 nt, Artificial Sequence
  Synthetic polynucleotide
uggacagcuucugccagagg

SEQ ID NO: 975 - RNA, 20 nt, Artificial Sequence
  Synthetic polynucleotide
cccaauggacagcuucugcc

SEQ ID NO: 976 - RNA, 20 nt, Artificial Sequence
  Synthetic polynucleotide
aauggacagcuucugccaga

SEQ ID NO: 977 - RNA, 20 nt, Artificial Sequence
  Synthetic polynucleotide
ggacagcuucugccagaggu

SEQ ID NO: 978 - RNA, 20 nt, Artificial Sequence
  Synthetic polynucleotide
agcuucugccagaggugaua

SEQ ID NO: 979 - RNA, 20 nt, Artificial Sequence
  Synthetic polynucleotide
caauggacagcuucugccag

SEQ ID NO: 980 - RNA, 20 nt, Artificial Sequence
  Synthetic polynucleotide
gcacgaccaaucaaauacac

SEQ ID NO: 981 - RNA, 20 nt, Artificial Sequence
  Synthetic polynucleotide
cacgaccaaucaaauacaca

SEQ ID NO: 982 - RNA, 20 nt, Artificial Sequence
  Synthetic polynucleotide
accaaucaaauacacaagaa

SEQ ID NO: 983 - RNA, 20 nt, Artificial Sequence
  Synthetic polynucleotide
ccaaucaaauacacaagaaa

SEQ ID NO: 984 - RNA, 20 nt, Artificial Sequence
  Synthetic polynucleotide
caaucaaauacacaagaaaa

SEQ ID NO: 985 - RNA, 20 nt, Artificial Sequence
  Synthetic polynucleotide
ggcacgaccaaucaaauaca

SEQ ID NO: 986 - RNA, 20 nt, Artificial Sequence
  Synthetic polynucleotide
ccaaucaaauacacaagaaa

SEQ ID NO: 987 - RNA, 20 nt, Artificial Sequence
  Synthetic polynucleotide
caaccucagacagagagcaa

SEQ ID NO: 988 - RNA, 20 nt, Artificial Sequence
  Synthetic polynucleotide
aaccucagacagagagcaau

SEQ ID NO: 989 - RNA, 20 nt, Artificial Sequence
  Synthetic polynucleotide
cucagacagagagcaaugag

SEQ ID NO: 990 - RNA, 20 nt, Artificial Sequence
  Synthetic polynucleotide
ucagacagagagcaaugagu

SEQ ID NO: 991 - RNA, 20 nt, Artificial Sequence
  Synthetic polynucleotide
cagacagagagcaaugagua

SEQ ID NO: 992 - RNA, 20 nt, Artificial Sequence
  Synthetic polynucleotide
gaucccaaccucagacagag

SEQ ID NO: 993 - RNA, 20 nt, Artificial Sequence
  Synthetic polynucleotide
ccaaccucagacagagagca

SEQ ID NO: 994 - RNA, 20 nt, Artificial Sequence
  Synthetic polynucleotide
ccagacaaaaauguccaccu

SEQ ID NO: 995 - RNA, 20 nt, Artificial Sequence
  Synthetic polynucleotide
cagacaaaaauguccaccuu

SEQ ID NO: 996 - RNA, 20 nt, Artificial Sequence
  Synthetic polynucleotide
gacaaaaauguccaccuugg

SEQ ID NO: 997 - RNA, 20 nt, Artificial Sequence
  Synthetic polynucleotide
guccagacaaaaauguccac

SEQ ID NO: 998 - RNA, 20 nt, Artificial Sequence
  Synthetic polynucleotide
cagacaaaaauguccaccuu

SEQ ID NO: 999 - RNA, 20 nt, Artificial Sequence
  Synthetic polynucleotide
ccagacaaaaauguccaccu

SEQ ID NO: 1000 - RNA, 20 nt, Artificial Sequence
  Synthetic polynucleotide
caagguggacauuuuugucu

SEQ ID NO: 1001 - RNA, 20 nt, Artificial Sequence
  Synthetic polynucleotide
ccaagguggacauuuuuguc

SEQ ID NO: 1002 - RNA, 20 nt, Artificial Sequence
  Synthetic polynucleotide
caaaucuguaccaccaaggu

SEQ ID NO: 1003 - RNA, 20 nt, Artificial Sequence
  Synthetic polynucleotide
gcaaaucuguaccaccaagg

SEQ ID NO: 1004 - RNA, 20 nt, Artificial Sequence
  Synthetic polynucleotide
aauuccagaucaagaauuug

SEQ ID NO: 1005 - RNA, 20 nt, Artificial Sequence
  Synthetic polynucleotide
gcaauuccagaucaagaauu

SEQ ID NO: 1006 - RNA, 20 nt, Artificial Sequence
  Synthetic polynucleotide
uccagaucaagaauuugugu

SEQ ID NO: 1007 - RNA, 20 nt, Artificial Sequence
  Synthetic polynucleotide
uauggagagcaauuccagau

SEQ ID NO: 1008 - RNA, 20 nt, Artificial Sequence
  Synthetic polynucleotide
ccaauauggagagcaauucc

SEQ ID NO: 1009 - RNA, 20 nt, Artificial Sequence
  Synthetic polynucleotide
uccaauauggagagcaauuc

SEQ ID NO: 1010 - RNA, 20 nt, Artificial Sequence
  Synthetic polynucleotide
ugaauuuuauccaauaugga

SEQ ID NO: 1011 - RNA, 20 nt, Artificial Sequence
  Synthetic polynucleotide
uugaauuuuauccaauaugg

SEQ ID NO: 1012 - RNA, 20 nt, Artificial Sequence
  Synthetic polynucleotide
auccaauauggagagcaauu

SEQ ID NO: 1013 - RNA, 20 nt, Artificial Sequence
  Synthetic polynucleotide
gaauuuuauccaauauggag

SEQ ID NO: 1014 - RNA, 20 nt, Artificial Sequence
  Synthetic polynucleotide
augaguauuuccaaguaggc

SEQ ID NO: 1015 - RNA, 20 nt, Artificial Sequence
  Synthetic polynucleotide
ugaguauuuccaaguaggcu

SEQ ID NO: 1016 - RNA, 20 nt, Artificial Sequence
  Synthetic polynucleotide
caaguaggcuggaauauuuu

SEQ ID NO: 1017 - RNA, 20 nt, Artificial Sequence
  Synthetic polynucleotide
augaguauuuccaaguaggc

SEQ ID NO: 1018 - RNA, 20 nt, Artificial Sequence
  Synthetic polynucleotide
aaaaauauuccagccuacuu

SEQ ID NO: 1019 - RNA, 20 nt, Artificial Sequence
  Synthetic polynucleotide
caaaaauauuccagccuacu

SEQ ID NO: 1020 - RNA, 20 nt, Artificial Sequence
  Synthetic polynucleotide
aaaaauauuccagccuacuu

SEQ ID NO: 1021 - RNA, 20 nt, Artificial Sequence
  Synthetic polynucleotide
uugucaguucugcgaucauu

SEQ ID NO: 1022 - RNA, 20 nt, Artificial Sequence
  Synthetic polynucleotide
ugucaguucugcgaucauuc

SEQ ID NO: 1023 - RNA, 20 nt, Artificial Sequence
  Synthetic polynucleotide
aguucugcgaucauucagac

SEQ ID NO: 1024 - RNA, 20 nt, Artificial Sequence
  Synthetic polynucleotide
ucaguucugcgaucauucag

SEQ ID NO: 1025 - RNA, 20 nt, Artificial Sequence
  Synthetic polynucleotide
gcuuuuagcuccgagucuuc

SEQ ID NO: 1026 - RNA, 20 nt, Artificial Sequence
  Synthetic polynucleotide
uuagcuccgagucuucaagu

SEQ ID NO: 1027 - RNA, 20 nt, Artificial Sequence
  Synthetic polynucleotide
gcuccgagucuucaaguugg

SEQ ID NO: 1028 - RNA, 20 nt, Artificial Sequence
  Synthetic polynucleotide
ccaggauuuugccaacuuga

SEQ ID NO: 1029 - RNA, 20 nt, Artificial Sequence
  Synthetic polynucleotide
gccaggauuuugccaacuug

SEQ ID NO: 1030 - RNA, 20 nt, Artificial Sequence
  Synthetic polynucleotide
uggccaggauuuugccaacu

SEQ ID NO: 1031 - RNA, 20 nt, Artificial Sequence
  Synthetic polynucleotide
guggucggcaugcagcucuu

SEQ ID NO: 1032 - RNA, 20 nt, Artificial Sequence
  Synthetic polynucleotide
ucggcaugcagcucuuuggu

SEQ ID NO: 1033 - RNA, 20 nt, Artificial Sequence
  Synthetic polynucleotide
cggcaugcagcucuuuggua

SEQ ID NO: 1034 - RNA, 20 nt, Artificial Sequence
  Synthetic polynucleotide
ggcaugcagcucuuugguaa

SEQ ID NO: 1035 - RNA, 20 nt, Artificial Sequence
  Synthetic polynucleotide
agcucuuugguaagagcuac

SEQ ID NO: 1036 - RNA, 20 nt, Artificial Sequence
  Synthetic polynucleotide
ugugccaccgugggagcgua

SEQ ID NO: 1037 - RNA, 20 nt, Artificial Sequence
  Synthetic polynucleotide
cguucaugugccaccguggg

SEQ ID NO: 1038 - RNA, 20 nt, Artificial Sequence
  Synthetic polynucleotide
ucguucaugugccaccgugg

SEQ ID NO: 1039 - RNA, 20 nt, Artificial Sequence
  Synthetic polynucleotide
caugugccaccgugggagcg

SEQ ID NO: 1040 - RNA, 20 nt, Artificial Sequence
  Synthetic polynucleotide
agucguucaugugccaccgu

SEQ ID NO: 1041 - RNA, 20 nt, Artificial Sequence
  Synthetic polynucleotide
ccacucuccacacagcacgc

SEQ ID NO: 1042 - RNA, 20 nt, Artificial Sequence
  Synthetic polynucleotide
uccacucuccacacagcacg

SEQ ID NO: 1043 - RNA, 20 nt, Artificial Sequence
  Synthetic polynucleotide
uauccacucuccacacagca

SEQ ID NO: 1044 - RNA, 20 nt, Artificial Sequence
  Synthetic polynucleotide
gucucuauccacucuccaca

SEQ ID NO: 1045 - RNA, 20 nt, Artificial Sequence
  Synthetic polynucleotide
ggaggucgcuggucaagcua

SEQ ID NO: 1046 - RNA, 20 nt, Artificial Sequence
  Synthetic polynucleotide
gcaaacaaccuccagauugc

SEQ ID NO: 1047 - RNA, 20 nt, Artificial Sequence
  Synthetic polynucleotide
aaacaaccuccagauugcag

SEQ ID NO: 1048 - RNA, 20 nt, Artificial Sequence
  Synthetic polynucleotide
aaccuccagauugcagugac

SEQ ID NO: 1049 - RNA, 20 nt, Artificial Sequence
  Synthetic polynucleotide
accuccagauugcagugacu

SEQ ID NO: 1050 - RNA, 20 nt, Artificial Sequence
  Synthetic polynucleotide
aaccuccagauugcagugac

SEQ ID NO: 1051 - RNA, 20 nt, Artificial Sequence
  Synthetic polynucleotide
caaccuccagauugcaguga

SEQ ID NO: 1052 - RNA, 20 nt, Artificial Sequence
  Synthetic polynucleotide
auuaugugaaacaaaccuua

SEQ ID NO: 1053 - RNA, 20 nt, Artificial Sequence
  Synthetic polynucleotide
uaugugaaacaaaccuuacg

SEQ ID NO: 1054 - RNA, 20 nt, Artificial Sequence
  Synthetic polynucleotide
uuaugugaaacaaaccuuac

SEQ ID NO: 1055 - RNA, 20 nt, Artificial Sequence
  Synthetic polynucleotide
cagggagauaagacaagcag

SEQ ID NO: 1056 - RNA, 20 nt, Artificial Sequence
  Synthetic polynucleotide
agggagauaagacaagcaga

SEQ ID NO: 1057 - RNA, 20 nt, Artificial Sequence
  Synthetic polynucleotide
gauaagacaagcagaagauc

SEQ ID NO: 1058 - RNA, 20 nt, Artificial Sequence
  Synthetic polynucleotide
aagcagaagaucugaauacu

SEQ ID NO: 1059 - RNA, 20 nt, Artificial Sequence
  Synthetic polynucleotide
agauaagacaagcagaagau

SEQ ID NO: 1060 - RNA, 20 nt, Artificial Sequence
  Synthetic polynucleotide
gugauggucaaucauuuauu

SEQ ID NO: 1061 - RNA, 20 nt, Artificial Sequence
  Synthetic polynucleotide
cauacacaaccugacaagaa

SEQ ID NO: 1062 - RNA, 20 nt, Artificial Sequence
  Synthetic polynucleotide
ccauacacaaccugacaaga

SEQ ID NO: 1063 - RNA, 20 nt, Artificial Sequence
  Synthetic polynucleotide
ccuccauacacaaccugaca

SEQ ID NO: 1064 - RNA, 20 nt, Artificial Sequence
  Synthetic polynucleotide
accuccauacacaaccugac

SEQ ID NO: 1065 - RNA, 20 nt, Artificial Sequence
  Synthetic polynucleotide
gagaaccuccauacacaacc

SEQ ID NO: 1066 - RNA, 20 nt, Artificial Sequence
  Synthetic polynucleotide
aaccuccauacacaaccuga

SEQ ID NO: 1067 - RNA, 20 nt, Artificial Sequence
  Synthetic polynucleotide
cucaugcugccaaguuaaca

SEQ ID NO: 1068 - RNA, 20 nt, Artificial Sequence
  Synthetic polynucleotide
cucaugcugccaaguuaaca

SEQ ID NO: 1069 - RNA, 20 nt, Artificial Sequence
  Synthetic polynucleotide
ucaugcugccaaguuaacau

SEQ ID NO: 1070 - RNA, 20 nt, Artificial Sequence
  Synthetic polynucleotide
caugcugccaaguuaacaua

SEQ ID NO: 1071 - RNA, 20 nt, Artificial Sequence
  Synthetic polynucleotide
cugccaaguuaacauagagu

SEQ ID NO: 1072 - RNA, 20 nt, Artificial Sequence
  Synthetic polynucleotide
ugccaaguuaacauagaguc

SEQ ID NO: 1073 - RNA, 20 nt, Artificial Sequence
  Synthetic polynucleotide
gccaaguuaacauagaguca

SEQ ID NO: 1074 - RNA, 20 nt, Artificial Sequence
  Synthetic polynucleotide
ccaaguuaacauagagucag

SEQ ID NO: 1075 - RNA, 20 nt, Artificial Sequence
  Synthetic polynucleotide
caccagauuuuuccuuuccc

SEQ ID NO: 1076 - RNA, 20 nt, Artificial Sequence
  Synthetic polynucleotide
aacuguguucaacaaucuug

SEQ ID NO: 1077 - RNA, 20 nt, Artificial Sequence
  Synthetic polynucleotide
cuuucaaaccaacuguguuc

SEQ ID NO: 1078 - RNA, 20 nt, Artificial Sequence
  Synthetic polynucleotide
uccauuuuagaagcauuucc

SEQ ID NO: 1079 - RNA, 20 nt, Artificial Sequence
  Synthetic polynucleotide
auccauuuuagaagcauuuc

SEQ ID NO: 1080 - RNA, 20 nt, Artificial Sequence
  Synthetic polynucleotide
ccauaugcuauccauuuuag

SEQ ID NO: 1081 - RNA, 20 nt, Artificial Sequence
  Synthetic polynucleotide
auccauuuuagaagcauuuc

SEQ ID NO: 1082 - RNA, 20 nt, Artificial Sequence
  Synthetic polynucleotide
uauccauuuuagaagcauuu

SEQ ID NO: 1083 - RNA, 20 nt, Artificial Sequence
  Synthetic polynucleotide
auaaccauaugcuauccauu

SEQ ID NO: 1084 - RNA, 20 nt, Artificial Sequence
  Synthetic polynucleotide
cagccaacaccaggcauugg

SEQ ID NO: 1085 - RNA, 20 nt, Artificial Sequence
  Synthetic polynucleotide
uccagccaacaccaggcauu

SEQ ID NO: 1086 - RNA, 20 nt, Artificial Sequence
  Synthetic polynucleotide
cagccaacaccaggcauugg

SEQ ID NO: 1087 - RNA, 20 nt, Artificial Sequence
  Synthetic polynucleotide
aaauccagccaacaccaggc

SEQ ID NO: 1088 - RNA, 20 nt, Artificial Sequence
  Synthetic polynucleotide
auccagccaacaccaggcau

SEQ ID NO: 1089 - RNA, 20 nt, Artificial Sequence
  Synthetic polynucleotide
auccagccaacaccaggcau

SEQ ID NO: 1090 - RNA, 20 nt, Artificial Sequence
  Synthetic polynucleotide
cagaauauaagacacacaag

SEQ ID NO: 1091 - RNA, 20 nt, Artificial Sequence
  Synthetic polynucleotide
agccagaauauaagacacac

SEQ ID NO: 1092 - RNA, 20 nt, Artificial Sequence
  Synthetic polynucleotide
ugaauaucagccagaauaua

SEQ ID NO: 1093 - RNA, 20 nt, Artificial Sequence
  Synthetic polynucleotide
cugaauaucagccagaauau

SEQ ID NO: 1094 - RNA, 20 nt, Artificial Sequence
  Synthetic polynucleotide
ucagccagaauauaagacac

SEQ ID NO: 1095 - RNA, 20 nt, Artificial Sequence
  Synthetic polynucleotide
agucaaguuccaaaucguuc

SEQ ID NO: 1096 - RNA, 20 nt, Artificial Sequence
  Synthetic polynucleotide
aagucaaguuccaaaucguu

SEQ ID NO: 1097 - RNA, 20 nt, Artificial Sequence
  Synthetic polynucleotide
ugaauguuagucaaaaugug

SEQ ID NO: 1098 - RNA, 20 nt, Artificial Sequence
  Synthetic polynucleotide
auguuagucaaaaugugcga

SEQ ID NO: 1099 - RNA, 20 nt, Artificial Sequence
  Synthetic polynucleotide
uguuagucaaaaugugcgau

SEQ ID NO: 1100 - RNA, 20 nt, Artificial Sequence
  Synthetic polynucleotide
uaugaauguuagucaaaaug

SEQ ID NO: 1101 - RNA, 20 nt, Artificial Sequence
  Synthetic polynucleotide
aaaugugcgauggaaaaacc

SEQ ID NO: 1102 - RNA, 20 nt, Artificial Sequence
  Synthetic polynucleotide
ugugcgauggaaaaaccuga

SEQ ID NO: 1103 - RNA, 20 nt, Artificial Sequence
  Synthetic polynucleotide
gugcgauggaaaaaccugaa

SEQ ID NO: 1104 - RNA, 20 nt, Artificial Sequence
  Synthetic polynucleotide
gcgauggaaaaaccugaaag

SEQ ID NO: 1105 - RNA, 20 nt, Artificial Sequence
  Synthetic polynucleotide
aaugugcgauggaaaaaccu

SEQ ID NO: 1106 - RNA, 20 nt, Artificial Sequence
  Synthetic polynucleotide
gguuuuuccaucgcacauuu

SEQ ID NO: 1107 - RNA, 20 nt, Artificial Sequence
  Synthetic polynucleotide
uauucuuaaaggcaacuuuu

SEQ ID NO: 1108 - RNA, 20 nt, Artificial Sequence
  Synthetic polynucleotide
auucuuaaaggcaacuuuua

SEQ ID NO: 1109 - RNA, 20 nt, Artificial Sequence
  Synthetic polynucleotide
uucuuaaaggcaacuuuuaa

SEQ ID NO: 1110 - RNA, 20 nt, Artificial Sequence
  Synthetic polynucleotide
ucuuaaaggcaacuuuuaag

SEQ ID NO: 1111 - RNA, 20 nt, Artificial Sequence
  Synthetic polynucleotide
uaaaggcaacuuuuaaggga

SEQ ID NO: 1112 - RNA, 20 nt, Artificial Sequence
  Synthetic polynucleotide
aaaggcaacuuuuaagggau

SEQ ID NO: 1113 - RNA, 20 nt, Artificial Sequence
  Synthetic polynucleotide
ggcaacuuuuaagggaugga

SEQ ID NO: 1114 - RNA, 20 nt, Artificial Sequence
  Synthetic polynucleotide
auucuuaaaggcaacuuuua

SEQ ID NO: 1115 - RNA, 20 nt, Artificial Sequence
  Synthetic polynucleotide
aaggcaacuuuuaagggaug

SEQ ID NO: 1116 - RNA, 20 nt, Artificial Sequence
  Synthetic polynucleotide
aucccuuaaaaguugccuuu

SEQ ID NO: 1117 - RNA, 20 nt, Artificial Sequence
  Synthetic polynucleotide
aauaaucguccaucccuuaa

SEQ ID NO: 1118 - RNA, 20 nt, Artificial Sequence
  Synthetic polynucleotide
aucccuuaaaaguugccuuu

SEQ ID NO: 1119 - RNA, 20 nt, Artificial Sequence
  Synthetic polynucleotide
auaauaaucguccaucccuu

SEQ ID NO: 1120 - RNA, 20 nt, Artificial Sequence
  Synthetic polynucleotide
caucccuuaaaaguugccuu

SEQ ID NO: 1121 - RNA, 20 nt, Artificial Sequence
  Synthetic polynucleotide
guagacaagcagcccaaaua

SEQ ID NO: 1122 - RNA, 20 nt, Artificial Sequence
  Synthetic polynucleotide
aagcagcccaaauaugaaua

SEQ ID NO: 1123 - RNA, 20 nt, Artificial Sequence
  Synthetic polynucleotide
cauagauaauuucaaccaac

SEQ ID NO: 1124 - RNA, 20 nt, Artificial Sequence
  Synthetic polynucleotide
auaauuucaaccaacagaaa

SEQ ID NO: 1125 - RNA, 20 nt, Artificial Sequence
  Synthetic polynucleotide
uaauuucaaccaacagaaaa

SEQ ID NO: 1126 - RNA, 20 nt, Artificial Sequence
  Synthetic polynucleotide
auuucaaccaacagaaaaag

SEQ ID NO: 1127 - RNA, 20 nt, Artificial Sequence
  Synthetic polynucleotide
uuucaaccaacagaaaaaga

SEQ ID NO: 1128 - RNA, 20 nt, Artificial Sequence
  Synthetic polynucleotide
aaccaacagaaaaagaagau

SEQ ID NO: 1129 - RNA, 20 nt, Artificial Sequence
  Synthetic polynucleotide
aauuucaaccaacagaaaaa

SEQ ID NO: 1130 - RNA, 20 nt, Artificial Sequence
  Synthetic polynucleotide
ucaaccaacagaaaaagaag

SEQ ID NO: 1131 - RNA, 20 nt, Artificial Sequence
  Synthetic polynucleotide
gauaauuucaaccaacagaa

SEQ ID NO: 1132 - RNA, 20 nt, Artificial Sequence
  Synthetic polynucleotide
auuucaaccaacagaaaaag

SEQ ID NO: 1133 - RNA, 20 nt, Artificial Sequence
  Synthetic polynucleotide
uuucaaccaacagaaaaaga

SEQ ID NO: 1134 - RNA, 20 nt, Artificial Sequence
  Synthetic polynucleotide
aaccaacagaaaaagaagau

SEQ ID NO: 1135 - RNA, 20 nt, Artificial Sequence
  Synthetic polynucleotide
aauuucaaccaacagaaaaa

SEQ ID NO: 1136 - RNA, 20 nt, Artificial Sequence
  Synthetic polynucleotide
ucaaccaacagaaaaagaag

SEQ ID NO: 1137 - RNA, 20 nt, Artificial Sequence
  Synthetic polynucleotide
agaaaaagaagauaaguauu

SEQ ID NO: 1138 - RNA, 20 nt, Artificial Sequence
  Synthetic polynucleotide
uggaggucaagacaucuuua

SEQ ID NO: 1139 - RNA, 20 nt, Artificial Sequence
  Synthetic polynucleotide
aggucaagacaucuuuauga

SEQ ID NO: 1140 - RNA, 20 nt, Artificial Sequence
  Synthetic polynucleotide
ggucaagacaucuuuaugac

SEQ ID NO: 1141 - RNA, 20 nt, Artificial Sequence
  Synthetic polynucleotide
ucaagacaucuuuaugacag

SEQ ID NO: 1142 - RNA, 20 nt, Artificial Sequence
  Synthetic polynucleotide
caagacaucuuuaugacaga

SEQ ID NO: 1143 - RNA, 20 nt, Artificial Sequence
  Synthetic polynucleotide
gaggucaagacaucuuuaug

SEQ ID NO: 1144 - RNA, 20 nt, Artificial Sequence
  Synthetic polynucleotide
gucaagacaucuuuaugaca

SEQ ID NO: 1145 - RNA, 20 nt, Artificial Sequence
  Synthetic polynucleotide
cagaagaacagaagaaauac

SEQ ID NO: 1146 - RNA, 20 nt, Artificial Sequence
  Synthetic polynucleotide
gaacagaagaaauacuauaa

SEQ ID NO: 1147 - RNA, 20 nt, Artificial Sequence
  Synthetic polynucleotide
agccacaaaagccaauuccu

SEQ ID NO: 1148 - RNA, 20 nt, Artificial Sequence
  Synthetic polynucleotide
acaaaagccaauuccucgac

SEQ ID NO: 1149 - RNA, 20 nt, Artificial Sequence
  Synthetic polynucleotide
caaaagccaauuccucgacc

SEQ ID NO: 1150 - RNA, 20 nt, Artificial Sequence
  Synthetic polynucleotide
aaaagccaauuccucgacca

SEQ ID NO: 1151 - RNA, 20 nt, Artificial Sequence
  Synthetic polynucleotide
aaagccaauuccucgaccag

SEQ ID NO: 1152 - RNA, 20 nt, Artificial Sequence
  Synthetic polynucleotide
aauuccucgaccagggguaa

SEQ ID NO: 1153 - RNA, 20 nt, Artificial Sequence
  Synthetic polynucleotide
aaaauccaaggauguauauu

SEQ ID NO: 1154 - RNA, 20 nt, Artificial Sequence
  Synthetic polynucleotide
ccaaggauguauauuugacc

SEQ ID NO: 1155 - RNA, 20 nt, Artificial Sequence
  Synthetic polynucleotide
caaggauguauauuugaccu

SEQ ID NO: 1156 - RNA, 20 nt, Artificial Sequence
  Synthetic polynucleotide
auccaaggauguauauuuga

SEQ ID NO: 1157 - RNA, 20 nt, Artificial Sequence
  Synthetic polynucleotide
cuagugacaaaucaagccuu

SEQ ID NO: 1158 - RNA, 20 nt, Artificial Sequence
  Synthetic polynucleotide
acaaaucaagccuuugauau

SEQ ID NO: 1159 - RNA, 20 nt, Artificial Sequence
  Synthetic polynucleotide
accuagugacaaaucaagcc

SEQ ID NO: 1160 - RNA, 20 nt, Artificial Sequence
  Synthetic polynucleotide
ugacaaaucaagccuuugau

SEQ ID NO: 1161 - RNA, 20 nt, Artificial Sequence
  Synthetic polynucleotide
ggagggucaaagucaacaua

SEQ ID NO: 1162 - RNA, 20 nt, Artificial Sequence
  Synthetic polynucleotide
ggucaaagucaacauaugac

SEQ ID NO: 1163 - RNA, 20 nt, Artificial Sequence
  Synthetic polynucleotide
ucaaagucaacauaugacug

SEQ ID NO: 1164 - RNA, 20 nt, Artificial Sequence
  Synthetic polynucleotide
ggucaaagucaacauaugac

SEQ ID NO: 1165 - RNA, 20 nt, Artificial Sequence
  Synthetic polynucleotide
ggucaaagucaacauaugac

SEQ ID NO: 1166 - RNA, 20 nt, Artificial Sequence
  Synthetic polynucleotide
ucaaagucaacauaugacug

SEQ ID NO: 1167 - RNA, 20 nt, Artificial Sequence
  Synthetic polynucleotide
ggucaaagucaacauaugac

SEQ ID NO: 1168 - RNA, 20 nt, Artificial Sequence
  Synthetic polynucleotide
auuuauccaauauaaaacuu

SEQ ID NO: 1169 - RNA, 20 nt, Artificial Sequence
  Synthetic polynucleotide
acauuuauccaauauaaaac

SEQ ID NO: 1170 - RNA, 20 nt, Artificial Sequence
  Synthetic polynucleotide
ccauccuacagugaaguagu

SEQ ID NO: 1171 - RNA, 20 nt, Artificial Sequence
  Synthetic polynucleotide
uccauccuacagugaaguag

SEQ ID NO: 1172 - RNA, 20 nt, Artificial Sequence
  Synthetic polynucleotide
uauuccauccuacagugaag

SEQ ID NO: 1173 - RNA, 20 nt, Artificial Sequence
  Synthetic polynucleotide
aaauauuccauccuacagug

SEQ ID NO: 1174 - RNA, 20 nt, Artificial Sequence
  Synthetic polynucleotide
aaaaauauuccauccuacag

SEQ ID NO: 1175 - RNA, 20 nt, Artificial Sequence
  Synthetic polynucleotide
ucaaaaauauuccauccuac

SEQ ID NO: 1176 - RNA, 20 nt, Artificial Sequence
  Synthetic polynucleotide
auuccauccuacagugaagu

SEQ ID NO: 1177 - RNA, 20 nt, Artificial Sequence
  Synthetic polynucleotide
aauauuccauccuacaguga

SEQ ID NO: 1178 - RNA, 20 nt, Artificial Sequence
  Synthetic polynucleotide
aaaaauauuccauccuacag

SEQ ID NO: 1179 - RNA, 20 nt, Artificial Sequence
  Synthetic polynucleotide
aaaucaaaaauauuccaucc

SEQ ID NO: 1180 - RNA, 20 nt, Artificial Sequence
  Synthetic polynucleotide
uuccgagugauccgucuugc

SEQ ID NO: 1181 - RNA, 20 nt, Artificial Sequence
  Synthetic polynucleotide
uccgagugauccgucuugcc

SEQ ID NO: 1182 - RNA, 20 nt, Artificial Sequence
  Synthetic polynucleotide
ccgagugauccgucuugcca

SEQ ID NO: 1183 - RNA, 20 nt, Artificial Sequence
  Synthetic polynucleotide
uuccgagugauccgucuugc

SEQ ID NO: 1184 - RNA, 20 nt, Artificial Sequence
  Synthetic polynucleotide
gauuggccgaauccuacguc

SEQ ID NO: 1185 - RNA, 20 nt, Artificial Sequence
  Synthetic polynucleotide
ccgaauccuacgucuaguca

SEQ ID NO: 1186 - RNA, 20 nt, Artificial Sequence
  Synthetic polynucleotide
cgaauccuacgucuagucaa

SEQ ID NO: 1187 - RNA, 20 nt, Artificial Sequence
  Synthetic polynucleotide
gaauccuacgucuagucaaa

SEQ ID NO: 1188 - RNA, 20 nt, Artificial Sequence
  Synthetic polynucleotide
aggauuggccgaauccuacg

SEQ ID NO: 1189 - RNA, 20 nt, Artificial Sequence
  Synthetic polynucleotide
cgaauccuacgucuagucaa

SEQ ID NO: 1190 - RNA, 20 nt, Artificial Sequence
  Synthetic polynucleotide
uuccaaauuacaaccucugc

SEQ ID NO: 1191 - RNA, 20 nt, Artificial Sequence
  Synthetic polynucleotide
aaauuacaaccucugcuggc

SEQ ID NO: 1192 - RNA, 20 nt, Artificial Sequence
  Synthetic polynucleotide
agccagcagagguuguaauu

SEQ ID NO: 1193 - RNA, 20 nt, Artificial Sequence
  Synthetic polynucleotide
caauccaucccagccagcag

SEQ ID NO: 1194 - RNA, 20 nt, Artificial Sequence
  Synthetic polynucleotide
gcaauccaucccagccagca

SEQ ID NO: 1195 - RNA, 20 nt, Artificial Sequence
  Synthetic polynucleotide
agcaauccaucccagccagc

SEQ ID NO: 1196 - RNA, 20 nt, Artificial Sequence
  Synthetic polynucleotide
ccaucccagccagcagaggu

SEQ ID NO: 1197 - RNA, 20 nt, Artificial Sequence
  Synthetic polynucleotide
agcaauccaucccagccagc

SEQ ID NO: 1198 - RNA, 20 nt, Artificial Sequence
  Synthetic polynucleotide
aaaccucauagaacaucuca

SEQ ID NO: 1199 - RNA, 20 nt, Artificial Sequence
  Synthetic polynucleotide
aaacuucucccaaaccucau

SEQ ID NO: 1200 - RNA, 20 nt, Artificial Sequence
  Synthetic polynucleotide
caaacuucucccaaaccuca

SEQ ID NO: 1201 - RNA, 20 nt, Artificial Sequence
  Synthetic polynucleotide
ccaaaccucauagaacaucu

SEQ ID NO: 1202 - RNA, 20 nt, Artificial Sequence
  Synthetic polynucleotide
ucaaacuucucccaaaccuc

SEQ ID NO: 1203 - RNA, 20 nt, Artificial Sequence
  Synthetic polynucleotide
cccgaugcgacccaguuuau

SEQ ID NO: 1204 - RNA, 20 nt, Artificial Sequence
  Synthetic polynucleotide
ccgaugcgacccaguuuaua

SEQ ID NO: 1205 - RNA, 20 nt, Artificial Sequence
  Synthetic polynucleotide
caaaguccagcucauugcca

SEQ ID NO: 1206 - RNA, 20 nt, Artificial Sequence
  Synthetic polynucleotide
aaaguccagcucauugccau

SEQ ID NO: 1207 - RNA, 20 nt, Artificial Sequence
  Synthetic polynucleotide
acaaaguccagcucauugcc

SEQ ID NO: 1208 - RNA, 20 nt, Artificial Sequence
  Synthetic polynucleotide
ucucuucguucacagaugga

SEQ ID NO: 1209 - RNA, 20 nt, Artificial Sequence
  Synthetic polynucleotide
cuucguucacagauggaaga

SEQ ID NO: 1210 - RNA, 20 nt, Artificial Sequence
  Synthetic polynucleotide
uucguucacagauggaagaa

SEQ ID NO: 1211 - RNA, 20 nt, Artificial Sequence
  Synthetic polynucleotide
ucuucguucacagauggaag

SEQ ID NO: 1212 - RNA, 20 nt, Artificial Sequence
  Synthetic polynucleotide
cuaaaacggaaacaagagga

SEQ ID NO: 1213 - RNA, 20 nt, Artificial Sequence
  Synthetic polynucleotide
acugucauucagcgugcuua

SEQ ID NO: 1214 - RNA, 20 nt, Artificial Sequence
  Synthetic polynucleotide
cugucauucagcgugcuuau

SEQ ID NO: 1215 - RNA, 20 nt, Artificial Sequence
  Synthetic polynucleotide
caaaaugucaaaaauauauc

SEQ ID NO: 1216 - RNA, 20 nt, Artificial Sequence
  Synthetic polynucleotide
accgcuuaaggcaaaauguc

SEQ ID NO: 1217 - RNA, 20 nt, Artificial Sequence
  Synthetic polynucleotide
ggcaaaaugucaaaaauaua

SEQ ID NO: 1218 - RNA, 20 nt, Artificial Sequence
  Synthetic polynucleotide
gaaauaugaacaagacagaa

SEQ ID NO: 1219 - RNA, 20 nt, Artificial Sequence
  Synthetic polynucleotide
aaauaugaacaagacagaac

SEQ ID NO: 1220 - RNA, 20 nt, Artificial Sequence
  Synthetic polynucleotide
augaacaagacagaacagaa

SEQ ID NO: 1221 - RNA, 20 nt, Artificial Sequence
  Synthetic polynucleotide
ugaacaagacagaacagaaa

SEQ ID NO: 1222 - RNA, 20 nt, Artificial Sequence
  Synthetic polynucleotide
gaacaagacagaacagaaaa

SEQ ID NO: 1223 - RNA, 20 nt, Artificial Sequence
  Synthetic polynucleotide
acaagacagaacagaaaagg

SEQ ID NO: 1224 - RNA, 20 nt, Artificial Sequence
  Synthetic polynucleotide
caagacagaacagaaaagga

SEQ ID NO: 1225 - RNA, 20 nt, Artificial Sequence
  Synthetic polynucleotide
agaaauaugaacaagacaga

SEQ ID NO: 1226 - RNA, 20 nt, Artificial Sequence
  Synthetic polynucleotide
uuacuugcaaccuagcccgc

SEQ ID NO: 1227 - RNA, 20 nt, Artificial Sequence
  Synthetic polynucleotide
aaaggcacuuacuugcaacc

SEQ ID NO: 1228 - RNA, 20 nt, Artificial Sequence
  Synthetic polynucleotide
acuuacuugcaaccuagccc

SEQ ID NO: 1229 - RNA, 20 nt, Artificial Sequence
  Synthetic polynucleotide
agaggccuggauggaaacaa

SEQ ID NO: 1230 - RNA, 20 nt, Artificial Sequence
  Synthetic polynucleotide
aagaggccuggauggaaaca

SEQ ID NO: 1231 - RNA, 20 nt, Artificial Sequence
  Synthetic polynucleotide
agaggccuggauggaaacaa

SEQ ID NO: 1232 - RNA, 20 nt, Artificial Sequence
  Synthetic polynucleotide
uaagaggccuggauggaaac

SEQ ID NO: 1233 - RNA, 20 nt, Artificial Sequence
  Synthetic polynucleotide
ccuuuuugucugcauaguag

SEQ ID NO: 1234 - RNA, 20 nt, Artificial Sequence
  Synthetic polynucleotide
accuuuuugucugcauagua

SEQ ID NO: 1235 - RNA, 20 nt, Artificial Sequence
  Synthetic polynucleotide
caccuuuuugucugcauagu

SEQ ID NO: 1236 - RNA, 20 nt, Artificial Sequence
  Synthetic polynucleotide
ucaccuuuuugucugcauag

SEQ ID NO: 1237 - RNA, 20 nt, Artificial Sequence
  Synthetic polynucleotide
aacucaccuuuuugucugca

SEQ ID NO: 1238 - RNA, 20 nt, Artificial Sequence
  Synthetic polynucleotide
caccuuuuugucugcauagu

SEQ ID NO: 1239 - RNA, 20 nt, Artificial Sequence
  Synthetic polynucleotide
uaaacucaccuuuuugucug

SEQ ID NO: 1240 - RNA, 20 nt, Artificial Sequence
  Synthetic polynucleotide
caccuuuuugucugcauagu

SEQ ID NO: 1241 - RNA, 20 nt, Artificial Sequence
  Synthetic polynucleotide
ucugcaggaggaaaaagaaa

SEQ ID NO: 1242 - RNA, 20 nt, Artificial Sequence
  Synthetic polynucleotide
gucugcaggaggaaaaagaa

SEQ ID NO: 1243 - RNA, 20 nt, Artificial Sequence
  Synthetic polynucleotide
agucugcaggaggaaaaaga

SEQ ID NO: 1244 - RNA, 20 nt, Artificial Sequence
  Synthetic polynucleotide
gaaagucugcaggaggaaaa

SEQ ID NO: 1245 - RNA, 20 nt, Artificial Sequence
  Synthetic polynucleotide
ugaaagucugcaggaggaaa

SEQ ID NO: 1246 - RNA, 20 nt, Artificial Sequence
  Synthetic polynucleotide
uacuaugaaagucugcagga

SEQ ID NO: 1247 - RNA, 20 nt, Artificial Sequence
  Synthetic polynucleotide
agucugcaggaggaaaaaga

SEQ ID NO: 1248 - RNA, 20 nt, Artificial Sequence
  Synthetic polynucleotide
augaaagucugcaggaggaa

SEQ ID NO: 1249 - RNA, 20 nt, Artificial Sequence
  Synthetic polynucleotide
cacucauauccuuuuaaaaa

SEQ ID NO: 1250 - RNA, 20 nt, Artificial Sequence
  Synthetic polynucleotide
uaguacacucauauccuuuu

SEQ ID NO: 1251 - RNA, 20 nt, Artificial Sequence
  Synthetic polynucleotide
uacacucauauccuuuuaaa

SEQ ID NO: 1252 - RNA, 20 nt, Artificial Sequence
  Synthetic polynucleotide
ugauucuaagcuaccuuauu

SEQ ID NO: 1253 - RNA, 20 nt, Artificial Sequence
  Synthetic polynucleotide
cuuacucgacauuuuugguc

SEQ ID NO: 1254 - RNA, 20 nt, Artificial Sequence
  Synthetic polynucleotide
acccacuuacucgacauuuu

SEQ ID NO: 1255 - RNA, 20 nt, Artificial Sequence
  Synthetic polynucleotide
acucgacauuuuugguccag

SEQ ID NO: 1256 - RNA, 20 nt, Artificial Sequence
  Synthetic polynucleotide
cacuuacucgacauuuuugg

SEQ ID NO: 1257 - RNA, 20 nt, Artificial Sequence
  Synthetic polynucleotide
auacccacuuacucgacauu

SEQ ID NO: 1258 - RNA, 20 nt, Artificial Sequence
  Synthetic polynucleotide
ccuaaacacaagauuccauu

SEQ ID NO: 1259 - RNA, 20 nt, Artificial Sequence
  Synthetic polynucleotide
accuaaacacaagauuccau

SEQ ID NO: 1260 - RNA, 20 nt, Artificial Sequence
  Synthetic polynucleotide
uaaaaguguaccuaaacaca

SEQ ID NO: 1261 - RNA, 20 nt, Artificial Sequence
  Synthetic polynucleotide
guaaaaguguaccuaaacac

SEQ ID NO: 1262 - RNA, 20 nt, Artificial Sequence
  Synthetic polynucleotide
accuaaacacaagauuccau

SEQ ID NO: 1263 - RNA, 20 nt, Artificial Sequence
  Synthetic polynucleotide
aguaaaaguguaccuaaaca

SEQ ID NO: 1264 - RNA, 20 nt, Artificial Sequence
  Synthetic polynucleotide
uacuuacgcaaaaacaauga

SEQ ID NO: 1265 - RNA, 20 nt, Artificial Sequence
  Synthetic polynucleotide
aaguacuuacgcaaaaacaa

SEQ ID NO: 1266 - RNA, 20 nt, Artificial Sequence
  Synthetic polynucleotide
uuacgcaaaaacaaugacga

SEQ ID NO: 1267 - RNA, 20 nt, Artificial Sequence
  Synthetic polynucleotide
gcugaaaguacuuacgcaaa

SEQ ID NO: 1268 - RNA, 20 nt, Artificial Sequence
  Synthetic polynucleotide
aauaccuguagaauuaaauc

SEQ ID NO: 1269 - RNA, 20 nt, Artificial Sequence
  Synthetic polynucleotide
aaauaccuguagaauuaaau

SEQ ID NO: 1270 - RNA, 20 nt, Artificial Sequence
  Synthetic polynucleotide
aaauaccuguagaauuaaau

SEQ ID NO: 1271 - RNA, 20 nt, Artificial Sequence
  Synthetic polynucleotide
ucuguuaaauaccuguagaa

SEQ ID NO: 1272 - RNA, 20 nt, Artificial Sequence
  Synthetic polynucleotide
uaaauaccuguagaauuaaa

SEQ ID NO: 1273 - RNA, 20 nt, Artificial Sequence
  Synthetic polynucleotide
cuuaccugggauuacagaaa

SEQ ID NO: 1274 - RNA, 20 nt, Artificial Sequence
  Synthetic polynucleotide
uacuucuuaccugggauuac

SEQ ID NO: 1275 - RNA, 20 nt, Artificial Sequence
  Synthetic polynucleotide
uuacuucuuaccugggauua

SEQ ID NO: 1276 - RNA, 20 nt, Artificial Sequence
  Synthetic polynucleotide
uucuuaccugggauuacaga

SEQ ID NO: 1277 - RNA, 20 nt, Artificial Sequence
  Synthetic polynucleotide
uacuucuuaccugggauuac

SEQ ID NO: 1278 - RNA, 20 nt, Artificial Sequence
  Synthetic polynucleotide
auuacuucuuaccugggauu

SEQ ID NO: 1279 - RNA, 20 nt, Artificial Sequence
  Synthetic polynucleotide
gccugaaaaugggagaaaaa

SEQ ID NO: 1280 - RNA, 20 nt, Artificial Sequence
  Synthetic polynucleotide
ggccugaaaaugggagaaaa

SEQ ID NO: 1281 - RNA, 20 nt, Artificial Sequence
  Synthetic polynucleotide
ucuucaggccugaaaauggg

SEQ ID NO: 1282 - RNA, 20 nt, Artificial Sequence
  Synthetic polynucleotide
gucuucaggccugaaaaugg

SEQ ID NO: 1283 - RNA, 20 nt, Artificial Sequence
  Synthetic polynucleotide
ugucuucaggccugaaaaug

SEQ ID NO: 1284 - RNA, 20 nt, Artificial Sequence
  Synthetic polynucleotide
uugucuucaggccugaaaau

SEQ ID NO: 1285 - RNA, 20 nt, Artificial Sequence
  Synthetic polynucleotide
caggccugaaaaugggagaa

SEQ ID NO: 1286 - RNA, 20 nt, Artificial Sequence
  Synthetic polynucleotide
ugucuucaggccugaaaaug

SEQ ID NO: 1287 - RNA, 20 nt, Artificial Sequence
  Synthetic polynucleotide
uugucuucaggccugaaaau

SEQ ID NO: 1288 - RNA, 20 nt, Artificial Sequence
  Synthetic polynucleotide
cuguugaagaagaauuugaa

SEQ ID NO: 1289 - RNA, 20 nt, Artificial Sequence
  Synthetic polynucleotide
uauucuguugaagaagaauu

SEQ ID NO: 1290 - RNA, 20 nt, Artificial Sequence
  Synthetic polynucleotide
uaaaaauauucuguugaaga

SEQ ID NO: 1291 - RNA, 20 nt, Artificial Sequence
  Synthetic polynucleotide
auaaaaauauucuguugaag

SEQ ID NO: 1292 - RNA, 20 nt, Artificial Sequence
  Synthetic polynucleotide
uucuguugaagaagaauuug

SEQ ID NO: 1293 - RNA, 20 nt, Artificial Sequence
  Synthetic polynucleotide
auaaaaauauucuguugaag

SEQ ID NO: 1294 - RNA, 20 nt, Artificial Sequence
  Synthetic polynucleotide
aauaaaaauauucuguugaa

SEQ ID NO: 1295 - RNA, 20 nt, Artificial Sequence
  Synthetic polynucleotide
aguaauaaaaauauucuguu

SEQ ID NO: 1296 - RNA, 20 nt, Artificial Sequence
  Synthetic polynucleotide
uacauacccugaaucugugc

SEQ ID NO: 1297 - RNA, 20 nt, Artificial Sequence
  Synthetic polynucleotide
aauauuacauacccugaauc

SEQ ID NO: 1298 - RNA, 20 nt, Artificial Sequence
  Synthetic polynucleotide
acacugacuacacacgagaa

SEQ ID NO: 1299 - RNA, 20 nt, Artificial Sequence
  Synthetic polynucleotide
gacacugacuacacacgaga

SEQ ID NO: 1300 - RNA, 20 nt, Artificial Sequence
  Synthetic polynucleotide
cuggacacugacuacacacg

SEQ ID NO: 1301 - RNA, 20 nt, Artificial Sequence
  Synthetic polynucleotide
ccuguugguaaagguuuucc

SEQ ID NO: 1302 - RNA, 20 nt, Artificial Sequence
  Synthetic polynucleotide
ugguacucaccuguugguaa

SEQ ID NO: 1303 - RNA, 20 nt, Artificial Sequence
  Synthetic polynucleotide
uugguacucaccuguuggua

SEQ ID NO: 1304 - RNA, 20 nt, Artificial Sequence
  Synthetic polynucleotide
caccuguugguaaagguuuu

SEQ ID NO: 1305 - RNA, 20 nt, Artificial Sequence
  Synthetic polynucleotide
cuugguacucaccuguuggu

SEQ ID NO: 1306 - RNA, 20 nt, Artificial Sequence
  Synthetic polynucleotide
cgcagcgucuagggaaaaau

SEQ ID NO: 1307 - RNA, 20 nt, Artificial Sequence
  Synthetic polynucleotide
acgcagcgucuagggaaaaa

SEQ ID NO: 1308 - RNA, 20 nt, Artificial Sequence
  Synthetic polynucleotide
cgcagcgucuagggaaaaau

SEQ ID NO: 1309 - RNA, 20 nt, Artificial Sequence
  Synthetic polynucleotide
gcagcacgcagcgucuaggg

SEQ ID NO: 1310 - RNA, 20 nt, Artificial Sequence
  Synthetic polynucleotide
gcaauugccugguugggcca

SEQ ID NO: 1311 - RNA, 20 nt, Artificial Sequence
  Synthetic polynucleotide
ugcaauugccugguugggcc

SEQ ID NO: 1312 - RNA, 20 nt, Artificial Sequence
  Synthetic polynucleotide
ggugguaccugauugggggu

SEQ ID NO: 1313 - RNA, 20 nt, Artificial Sequence
  Synthetic polynucleotide
gggugguaccugauuggggg

SEQ ID NO: 1314 - RNA, 20 nt, Artificial Sequence
  Synthetic polynucleotide
uuugggugguaccugauugg

SEQ ID NO: 1315 - RNA, 20 nt, Artificial Sequence
  Synthetic polynucleotide
aauuugggugguaccugauu

SEQ ID NO: 1316 - RNA, 20 nt, Artificial Sequence
  Synthetic polynucleotide
aauuugggugguaccugauu

SEQ ID NO: 1317 - RNA, 20 nt, Artificial Sequence
  Synthetic polynucleotide
augcugaguggugacugcag

SEQ ID NO: 1318 - RNA, 20 nt, Artificial Sequence
  Synthetic polynucleotide
ucuauuaucaccucuggcag

SEQ ID NO: 1319 - RNA, 20 nt, Artificial Sequence
  Synthetic polynucleotide
uaucuauuaucaccucuggc

SEQ ID NO: 1320 - RNA, 20 nt, Artificial Sequence
  Synthetic polynucleotide
cuuaucuauuaucaccucug

SEQ ID NO: 1321 - RNA, 20 nt, Artificial Sequence
  Synthetic polynucleotide
cguccuuacgcugucaucag

SEQ ID NO: 1322 - RNA, 20 nt, Artificial Sequence
  Synthetic polynucleotide
aacguccuuacgcugucauc

SEQ ID NO: 1323 - RNA, 20 nt, Artificial Sequence
  Synthetic polynucleotide
aaacguccuuacgcugucau

SEQ ID NO: 1324 - RNA, 20 nt, Artificial Sequence
  Synthetic polynucleotide
aacguccuuacgcugucauc

SEQ ID NO: 1325 - RNA, 20 nt, Artificial Sequence
  Synthetic polynucleotide
aaaacguccuuacgcuguca

SEQ ID NO: 1326 - RNA, 20 nt, Artificial Sequence
  Synthetic polynucleotide
gugcccuaaaaaaaaaauca

SEQ ID NO: 1327 - RNA, 20 nt, Artificial Sequence
  Synthetic polynucleotide
ggucgugcccuaaaaaaaaa

SEQ ID NO: 1328 - RNA, 20 nt, Artificial Sequence
  Synthetic polynucleotide
gauuggucgugcccuaaaaa

SEQ ID NO: 1329 - RNA, 20 nt, Artificial Sequence
  Synthetic polynucleotide
gauuauuacauaccuuccac

SEQ ID NO: 1330 - RNA, 20 nt, Artificial Sequence
  Synthetic polynucleotide
acauaccuuccacaguguuu

SEQ ID NO: 1331 - RNA, 20 nt, Artificial Sequence
  Synthetic polynucleotide
guucugggagaaaaaagcag

SEQ ID NO: 1332 - RNA, 20 nt, Artificial Sequence
  Synthetic polynucleotide
aguucugggagaaaaaagca

SEQ ID NO: 1333 - RNA, 20 nt, Artificial Sequence
  Synthetic polynucleotide
aaguucugggagaaaaaagc

SEQ ID NO: 1334 - RNA, 20 nt, Artificial Sequence
  Synthetic polynucleotide
caaguucugggagaaaaaag

SEQ ID NO: 1335 - RNA, 20 nt, Artificial Sequence
  Synthetic polynucleotide
ucaaguucugggagaaaaaa

SEQ ID NO: 1336 - RNA, 20 nt, Artificial Sequence
  Synthetic polynucleotide
cuucaaguucugggagaaaa

SEQ ID NO: 1337 - RNA, 20 nt, Artificial Sequence
  Synthetic polynucleotide
aaguucugggagaaaaaagc

SEQ ID NO: 1338 - RNA, 20 nt, Artificial Sequence
  Synthetic polynucleotide
cuuaccaaauuuccuauagc

SEQ ID NO: 1339 - RNA, 20 nt, Artificial Sequence
  Synthetic polynucleotide
gagacuuaccaaauuuccua

SEQ ID NO: 1340 - RNA, 20 nt, Artificial Sequence
  Synthetic polynucleotide
gacuuaccaaauuuccuaua

SEQ ID NO: 1341 - RNA, 20 nt, Artificial Sequence
  Synthetic polynucleotide
uuccaguaaagaccuaagug

SEQ ID NO: 1342 - RNA, 20 nt, Artificial Sequence
  Synthetic polynucleotide
gauuccaguaaagaccuaag

SEQ ID NO: 1343 - RNA, 20 nt, Artificial Sequence
  Synthetic polynucleotide
guaaagaccuaagugagaaa

SEQ ID NO: 1344 - RNA, 20 nt, Artificial Sequence
  Synthetic polynucleotide
ccaguaaagaccuaagugag

SEQ ID NO: 1345 - RNA, 20 nt, Artificial Sequence
  Synthetic polynucleotide
gauuccaguaaagaccuaag

SEQ ID NO: 1346 - RNA, 20 nt, Artificial Sequence
  Synthetic polynucleotide
uuaccagucugaaugaucgc

SEQ ID NO: 1347 - RNA, 20 nt, Artificial Sequence
  Synthetic polynucleotide
uuuaccagucugaaugaucg

SEQ ID NO: 1348 - RNA, 20 nt, Artificial Sequence
  Synthetic polynucleotide
uuuauguuuaccagucugaa

SEQ ID NO: 1349 - RNA, 20 nt, Artificial Sequence
  Synthetic polynucleotide
aguuuauguuuaccagucug

SEQ ID NO: 1350 - RNA, 20 nt, Artificial Sequence
  Synthetic polynucleotide
guuuaccagucugaaugauc

SEQ ID NO: 1351 - RNA, 20 nt, Artificial Sequence
  Synthetic polynucleotide
cggagcuaaaagcaaauaua

SEQ ID NO: 1352 - RNA, 20 nt, Artificial Sequence
  Synthetic polynucleotide
agcuaaaagcaaauauaaag

SEQ ID NO: 1353 - RNA, 20 nt, Artificial Sequence
  Synthetic polynucleotide
cucggagcuaaaagcaaaua

SEQ ID NO: 1354 - RNA, 20 nt, Artificial Sequence
  Synthetic polynucleotide
uugaagacucggagcuaaaa

SEQ ID NO: 1355 - RNA, 20 nt, Artificial Sequence
  Synthetic polynucleotide
caccagguuuccaaugacca

SEQ ID NO: 1356 - RNA, 20 nt, Artificial Sequence
  Synthetic polynucleotide
acauaccaccagguuuccaa

SEQ ID NO: 1357 - RNA, 20 nt, Artificial Sequence
  Synthetic polynucleotide
ugguuacauaccaccagguu

SEQ ID NO: 1358 - RNA, 20 nt, Artificial Sequence
  Synthetic polynucleotide
cuauaucaggguggggagag

SEQ ID NO: 1359 - RNA, 20 nt, Artificial Sequence
  Synthetic polynucleotide
ccuauaucaggguggggaga

SEQ ID NO: 1360 - RNA, 20 nt, Artificial Sequence
  Synthetic polynucleotide
accuauaucaggguggggag

SEQ ID NO: 1361 - RNA, 20 nt, Artificial Sequence
  Synthetic polynucleotide
gaccuauaucagggugggga

SEQ ID NO: 1362 - RNA, 20 nt, Artificial Sequence
  Synthetic polynucleotide
ggaccuauaucagggugggg

SEQ ID NO: 1363 - RNA, 20 nt, Artificial Sequence
  Synthetic polynucleotide
aggaccuauaucaggguggg

SEQ ID NO: 1364 - RNA, 20 nt, Artificial Sequence
  Synthetic polynucleotide
uaggaccuauaucagggugg

SEQ ID NO: 1365 - RNA, 20 nt, Artificial Sequence
  Synthetic polynucleotide
uuaggaccuauaucagggug

SEQ ID NO: 1366 - RNA, 20 nt, Artificial Sequence
  Synthetic polynucleotide
uuuaggaccuauaucagggu

SEQ ID NO: 1367 - RNA, 20 nt, Artificial Sequence
  Synthetic polynucleotide
guuuaggaccuauaucaggg

SEQ ID NO: 1368 - RNA, 20 nt, Artificial Sequence
  Synthetic polynucleotide
agguuuaggaccuauaucag

SEQ ID NO: 1369 - RNA, 20 nt, Artificial Sequence
  Synthetic polynucleotide
ccuauaucaggguggggaga

SEQ ID NO: 1370 - RNA, 20 nt, Artificial Sequence
  Synthetic polynucleotide
aauagguuuaggaccuauau

SEQ ID NO: 1371 - RNA, 20 nt, Artificial Sequence
  Synthetic polynucleotide
ccuauaucaggguggggaga

SEQ ID NO: 1372 - RNA, 20 nt, Artificial Sequence
  Synthetic polynucleotide
accuauaucaggguggggag

SEQ ID NO: 1373 - RNA, 20 nt, Artificial Sequence
  Synthetic polynucleotide
uuaggaccuauaucagggug

SEQ ID NO: 1374 - RNA, 20 nt, Artificial Sequence
  Synthetic polynucleotide
aggaccuauaucaggguggg

SEQ ID NO: 1375 - RNA, 20 nt, Artificial Sequence
  Synthetic polynucleotide
guuuaggaccuauaucaggg

SEQ ID NO: 1376 - RNA, 20 nt, Artificial Sequence
  Synthetic polynucleotide
uagguuuaggaccuauauca

SEQ ID NO: 1377 - RNA, 20 nt, Artificial Sequence
  Synthetic polynucleotide
ccaucugugaaacaggccuc

SEQ ID NO: 1378 - RNA, 20 nt, Artificial Sequence
  Synthetic polynucleotide
ugucuuaccaucugugaaac

SEQ ID NO: 1379 - RNA, 20 nt, Artificial Sequence
  Synthetic polynucleotide
uugucuuaccaucugugaaa

SEQ ID NO: 1380 - RNA, 20 nt, Artificial Sequence
  Synthetic polynucleotide
cauacacaaccugacaagaa

SEQ ID NO: 1381 - RNA, 20 nt, Artificial Sequence
  Synthetic polynucleotide
ccauacacaaccugacaaga

SEQ ID NO: 1382 - RNA, 20 nt, Artificial Sequence
  Synthetic polynucleotide
aaccuccauacacaaccuga

SEQ ID NO: 1383 - RNA, 20 nt, Artificial Sequence
  Synthetic polynucleotide
ccagggcaccacugcugagc

SEQ ID NO: 1384 - RNA, 20 nt, Artificial Sequence
  Synthetic polynucleotide
accagggcaccacugcugag

SEQ ID NO: 1385 - RNA, 20 nt, Artificial Sequence
  Synthetic polynucleotide
uuuaccagggcaccacugcu

SEQ ID NO: 1386 - RNA, 20 nt, Artificial Sequence
  Synthetic polynucleotide
auuuaccagggcaccacugc

SEQ ID NO: 1387 - RNA, 20 nt, Artificial Sequence
  Synthetic polynucleotide
accagggcaccacugcugag

SEQ ID NO: 1388 - RNA, 20 nt, Artificial Sequence
  Synthetic polynucleotide
agccuguggaaauaauauuc

SEQ ID NO: 1389 - RNA, 20 nt, Artificial Sequence
  Synthetic polynucleotide
aaagccuguggaaauaauau

SEQ ID NO: 1390 - RNA, 20 nt, Artificial Sequence
  Synthetic polynucleotide
uaucuucaaaagccugugga

SEQ ID NO: 1391 - RNA, 20 nt, Artificial Sequence
  Synthetic polynucleotide
acaucaacaauuaggaaauc

SEQ ID NO: 1392 - RNA, 20 nt, Artificial Sequence
  Synthetic polynucleotide
aguaccuacaucaacaauua

SEQ ID NO: 1393 - RNA, 20 nt, Artificial Sequence
  Synthetic polynucleotide
aaguaccuacaucaacaauu

SEQ ID NO: 1394 - RNA, 20 nt, Artificial Sequence
  Synthetic polynucleotide
aaaguaccuacaucaacaau

SEQ ID NO: 1395 - RNA, 20 nt, Artificial Sequence
  Synthetic polynucleotide
aguaccuacaucaacaauua

SEQ ID NO: 1396 - RNA, 20 nt, Artificial Sequence
  Synthetic polynucleotide
acccucauuccuucaaaucu

SEQ ID NO: 1397 - RNA, 20 nt, Artificial Sequence
  Synthetic polynucleotide
uacccucauuccuucaaauc

SEQ ID NO: 1398 - RNA, 20 nt, Artificial Sequence
  Synthetic polynucleotide
uuacccucauuccuucaaau

SEQ ID NO: 1399 - RNA, 20 nt, Artificial Sequence
  Synthetic polynucleotide
auuuucuuacccucauuccu

SEQ ID NO: 1400 - RNA, 20 nt, Artificial Sequence
  Synthetic polynucleotide
cuaguauucaaaagaaagaa

SEQ ID NO: 1401 - RNA, 20 nt, Artificial Sequence
  Synthetic polynucleotide
cgaccuaguauucaaaagaa

SEQ ID NO: 1402 - RNA, 20 nt, Artificial Sequence
  Synthetic polynucleotide
acgaccuaguauucaaaaga

SEQ ID NO: 1403 - RNA, 20 nt, Artificial Sequence
  Synthetic polynucleotide
acaacgaccuaguauucaaa

SEQ ID NO: 1404 - RNA, 20 nt, Artificial Sequence
  Synthetic polynucleotide
cacaacgaccuaguauucaa

SEQ ID NO: 1405 - RNA, 20 nt, Artificial Sequence
  Synthetic polynucleotide
aacgaccuaguauucaaaag

SEQ ID NO: 1406 - RNA, 20 nt, Artificial Sequence
  Synthetic polynucleotide
ucacaacgaccuaguauuca

SEQ ID NO: 1407 - RNA, 20 nt, Artificial Sequence
  Synthetic polynucleotide
uuacaacuugaagcagagau

SEQ ID NO: 1408 - RNA, 20 nt, Artificial Sequence
  Synthetic polynucleotide
cuuacaacuugaagcagaga

SEQ ID NO: 1409 - RNA, 20 nt, Artificial Sequence
  Synthetic polynucleotide
acacuuacaacuugaagcag

SEQ ID NO: 1410 - RNA, 20 nt, Artificial Sequence
  Synthetic polynucleotide
gacacuuacaacuugaagca

SEQ ID NO: 1411 - RNA, 20 nt, Artificial Sequence
  Synthetic polynucleotide
ggacacuuacaacuugaagc

SEQ ID NO: 1412 - RNA, 20 nt, Artificial Sequence
  Synthetic polynucleotide
gggacacuuacaacuugaag

SEQ ID NO: 1413 - RNA, 20 nt, Artificial Sequence
  Synthetic polynucleotide
acuuacaacuugaagcagag

SEQ ID NO: 1414 - RNA, 20 nt, Artificial Sequence
  Synthetic polynucleotide
ggacacuuacaacuugaagc

SEQ ID NO: 1415 - RNA, 20 nt, Artificial Sequence
  Synthetic polynucleotide
ccuuuaagaauaacauuaau

SEQ ID NO: 1416 - RNA, 20 nt, Artificial Sequence
  Synthetic polynucleotide
gccuuuaagaauaacauuaa

SEQ ID NO: 1417 - RNA, 20 nt, Artificial Sequence
  Synthetic polynucleotide
gccuuuaagaauaacauuaa

SEQ ID NO: 1418 - RNA, 20 nt, Artificial Sequence
  Synthetic polynucleotide
aaguugccuuuaagaauaac

SEQ ID NO: 1419 - RNA, 20 nt, Artificial Sequence
  Synthetic polynucleotide
ugccuuuaagaauaacauua

SEQ ID NO: 1420 - RNA, 20 nt, Artificial Sequence
  Synthetic polynucleotide
auaaucaauacuuacauuaa

SEQ ID NO: 1421 - RNA, 20 nt, Artificial Sequence
  Synthetic polynucleotide
gauaaucaauacuuacauua

SEQ ID NO: 1422 - RNA, 20 nt, Artificial Sequence
  Synthetic polynucleotide
ccuauaaaauuuacaaaagu

SEQ ID NO: 1423 - RNA, 20 nt, Artificial Sequence
  Synthetic polynucleotide
ucuaccuauaaaauuuacaa

SEQ ID NO: 1424 - RNA, 20 nt, Artificial Sequence
  Synthetic polynucleotide
ugucuaccuauaaaauuuac

SEQ ID NO: 1425 - RNA, 20 nt, Artificial Sequence
  Synthetic polynucleotide
uaucuucuuuuucuguuggu

SEQ ID NO: 1426 - RNA, 20 nt, Artificial Sequence
  Synthetic polynucleotide
uacuuaucuucuuuuucugu

SEQ ID NO: 1427 - RNA, 20 nt, Artificial Sequence
  Synthetic polynucleotide
uaucuucuuuuucuguuggu

SEQ ID NO: 1428 - RNA, 20 nt, Artificial Sequence
  Synthetic polynucleotide
aauacuuaucuucuuuuucu

SEQ ID NO: 1429 - RNA, 20 nt, Artificial Sequence
  Synthetic polynucleotide
uuuaccccuggucgaggaau

SEQ ID NO: 1430 - RNA, 20 nt, Artificial Sequence
  Synthetic polynucleotide
auuuuuuuaccccuggucga

SEQ ID NO: 1431 - RNA, 20 nt, Artificial Sequence
  Synthetic polynucleotide
uauuuuuuuaccccuggucg

SEQ ID NO: 1432 - RNA, 20 nt, Artificial Sequence
  Synthetic polynucleotide
auauuuuuuuaccccugguc

SEQ ID NO: 1433 - RNA, 20 nt, Artificial Sequence
  Synthetic polynucleotide
uauauuuuuuuaccccuggu

SEQ ID NO: 1434 - RNA, 20 nt, Artificial Sequence
  Synthetic polynucleotide
uauuuuuuuaccccuggucg

SEQ ID NO: 1435 - RNA, 20 nt, Artificial Sequence
  Synthetic polynucleotide
uuuuguucugcaaagaaaua

SEQ ID NO: 1436 - RNA, 20 nt, Artificial Sequence
  Synthetic polynucleotide
auuuuguucugcaaagaaau

SEQ ID NO: 1437 - RNA, 20 nt, Artificial Sequence
  Synthetic polynucleotide
uuguucugcaaagaaauaag

SEQ ID NO: 1438 - RNA, 20 nt, Artificial Sequence
  Synthetic polynucleotide
auuuuguucugcaaagaaau

SEQ ID NO: 1439 - RNA, 20 nt, Artificial Sequence
  Synthetic polynucleotide
ccuuggauuuuguucugcaa

SEQ ID NO: 1440 - RNA, 20 nt, Artificial Sequence
  Synthetic polynucleotide
gauuuuguucugcaaagaaa

SEQ ID NO: 1441 - RNA, 20 nt, Artificial Sequence
  Synthetic polynucleotide
aauauucuuaccuacaaugg

SEQ ID NO: 1442 - RNA, 20 nt, Artificial Sequence
  Synthetic polynucleotide
aaauauucuuaccuacaaug

SEQ ID NO: 1443 - RNA, 20 nt, Artificial Sequence
  Synthetic polynucleotide
uaaauauucuuaccuacaau

SEQ ID NO: 1444 - RNA, 20 nt, Artificial Sequence
  Synthetic polynucleotide
auauucuuaccuacaaugga

SEQ ID NO: 1445 - RNA, 20 nt, Artificial Sequence
  Synthetic polynucleotide
uaaauauucuuaccuacaau

SEQ ID NO: 1446 - RNA, 20 nt, Artificial Sequence
  Synthetic polynucleotide
auaaauauucuuaccuacaa

SEQ ID NO: 1447 - RNA, 20 nt, Artificial Sequence
  Synthetic polynucleotide
cuguauguggaggaaaauaa

SEQ ID NO: 1448 - RNA, 20 nt, Artificial Sequence
  Synthetic polynucleotide
gaaacauaccuguaugugga

SEQ ID NO: 1449 - RNA, 20 nt, Artificial Sequence
  Synthetic polynucleotide
agaaacauaccuguaugugg

SEQ ID NO: 1450 - RNA, 20 nt, Artificial Sequence
  Synthetic polynucleotide
uagaaacauaccuguaugug

SEQ ID NO: 1451 - RNA, 20 nt, Artificial Sequence
  Synthetic polynucleotide
cuagaaacauaccuguaugu

SEQ ID NO: 1452 - RNA, 20 nt, Artificial Sequence
  Synthetic polynucleotide
cauaccuguauguggaggaa

SEQ ID NO: 1453 - RNA, 20 nt, Artificial Sequence
  Synthetic polynucleotide
aaacauaccuguauguggag

SEQ ID NO: 1454 - RNA, 20 nt, Artificial Sequence
  Synthetic polynucleotide
ccuguauguggaggaaaaua

SEQ ID NO: 1455 - RNA, 20 nt, Artificial Sequence
  Synthetic polynucleotide
gcuagaaacauaccuguaug

SEQ ID NO: 1456 - RNA, 20 nt, Artificial Sequence
  Synthetic polynucleotide
cuagaaacauaccuguaugu

SEQ ID NO: 1457 - RNA, 15 nt, Artificial Sequence
  Synthetic polynucleotide
cagggcaagaaggcc

SEQ ID NO: 1458 - RNA, 13 nt, Artificial Sequence
  Synthetic polynucleotide
cgccaccaggccc

SEQ ID NO: 1459 - RNA, 18 nt, Artificial Sequence
  Synthetic polynucleotide
cagcagacaaaaagggag

SEQ ID NO: 1460 - RNA, 13 nt, Artificial Sequence
  Synthetic polynucleotide
cccccgcagacca

SEQ ID NO: 1461 - RNA, 16 nt, Artificial Sequence
  Synthetic polynucleotide
agacaccaaccaaaaa

SEQ ID NO: 1462 - RNA, 14 nt, Artificial Sequence
  Synthetic polynucleotide
gacaagcaccacag

SEQ ID NO: 1463 - RNA, 18 nt, Artificial Sequence
  Synthetic polynucleotide
ccaaaaagcgagaagggg

SEQ ID NO: 1464 - RNA, 12 nt, Artificial Sequence
  Synthetic polynucleotide
acggaggacaca

SEQ ID NO: 1465 - RNA, 14 nt, Artificial Sequence
  Synthetic polynucleotide
aggcgaagaccagc

SEQ ID NO: 1466 - RNA, 16 nt, Artificial Sequence
  Synthetic polynucleotide
aaacacaggaaacaga

SEQ ID NO: 1467 - RNA, 18 nt, Artificial Sequence
  Synthetic polynucleotide
cgaacccaggaagaagaa

SEQ ID NO: 1468 - RNA, 17 nt, Artificial Sequence
  Synthetic polynucleotide
ccccacaggccgaagac

SEQ ID NO: 1469 - RNA, 12 nt, Artificial Sequence
  Synthetic polynucleotide
cccaacagaaaa

SEQ ID NO: 1470 - RNA, 16 nt, Artificial Sequence
  Synthetic polynucleotide
cacagacagggagaaa

SEQ ID NO: 1471 - RNA, 13 nt, Artificial Sequence
  Synthetic polynucleotide
cccgggagcaggc

SEQ ID NO: 1472 - RNA, 18 nt, Artificial Sequence
  Synthetic polynucleotide
caccaacagggagaccaa

SEQ ID NO: 1473 - RNA, 15 nt, Artificial Sequence
  Synthetic polynucleotide
ccacccagacgcgcg

SEQ ID NO: 1474 - RNA, 19 nt, Artificial Sequence
  Synthetic polynucleotide
cggcccaaccaggcaagca

SEQ ID NO: 1475 - RNA, 21 nt, Artificial Sequence
  Synthetic polynucleotide
cccccaacaggaccacccaaa

SEQ ID NO: 1476 - RNA, 17 nt, Artificial Sequence
  Synthetic polynucleotide
acgcagcaccaccagca

SEQ ID NO: 1477 - RNA, 17 nt, Artificial Sequence
  Synthetic polynucleotide
cgccagagggaaaagaa

SEQ ID NO: 1478 - RNA, 17 nt, Artificial Sequence
  Synthetic polynucleotide
cgagacagcgaaggacg

SEQ ID NO: 1479 - RNA, 14 nt, Artificial Sequence
  Synthetic polynucleotide
agaagggcacgacc

SEQ ID NO: 1480 - RNA, 17 nt, Artificial Sequence
  Synthetic polynucleotide
cacgggaaggagaaaac

SEQ ID NO: 1481 - RNA, 14 nt, Artificial Sequence
  Synthetic polynucleotide
cccccagaacgaag

SEQ ID NO: 1482 - RNA, 15 nt, Artificial Sequence
  Synthetic polynucleotide
caaggaaaggaagcc

SEQ ID NO: 1483 - RNA, 13 nt, Artificial Sequence
  Synthetic polynucleotide
accacaggcacgg

SEQ ID NO: 1484 - RNA, 18 nt, Artificial Sequence
  Synthetic polynucleotide
acacagacggaaacaaaa

SEQ ID NO: 1485 - RNA, 14 nt, Artificial Sequence
  Synthetic polynucleotide
acaagcagcccgag

SEQ ID NO: 1486 - RNA, 19 nt, Artificial Sequence
  Synthetic polynucleotide
aggaaaccggggagaacca

SEQ ID NO: 1487 - RNA, 18 nt, Artificial Sequence
  Synthetic polynucleotide
ccacccgaaaggccaaac

SEQ ID NO: 1488 - RNA, 17 nt, Artificial Sequence
  Synthetic polynucleotide
cgcacagaggaagacaa

SEQ ID NO: 1489 - RNA, 12 nt, Artificial Sequence
  Synthetic polynucleotide
gccgcaggggag

SEQ ID NO: 1490 - RNA, 18 nt, Artificial Sequence
  Synthetic polynucleotide
ccagcaggggcccggaaa

SEQ ID NO: 1491 - RNA, 16 nt, Artificial Sequence
  Synthetic polynucleotide
aaccacaggcgaagaa

SEQ ID NO: 1492 - RNA, 13 nt, Artificial Sequence
  Synthetic polynucleotide
ccaaggagaggac

SEQ ID NO: 1493 - RNA, 20 nt, Artificial Sequence
  Synthetic polynucleotide
agaaggaagagggaagaaaa

SEQ ID NO: 1494 - RNA, 13 nt, Artificial Sequence
  Synthetic polynucleotide
cgaaacaggcggg

SEQ ID NO: 1495 - RNA, 15 nt, Artificial Sequence
  Synthetic polynucleotide
cgccaaggaaggccc

SEQ ID NO: 1496 - RNA, 15 nt, Artificial Sequence
  Synthetic polynucleotide
aaagacaaaggcaac

SEQ ID NO: 1497 - RNA, 13 nt, Artificial Sequence
  Synthetic polynucleotide
acgaagaagagaa

SEQ ID NO: 1498 - RNA, 15 nt, Artificial Sequence
  Synthetic polynucleotide
acgaaaaaggagaca

SEQ ID NO: 1499 - RNA, 22 nt, Artificial Sequence
  Synthetic polynucleotide
accaacagaaaaagaagaaaga

SEQ ID NO: 1500 - RNA, 20 nt, Artificial Sequence
  Synthetic polynucleotide
ccgaccaggggaaaaaaaaa

SEQ ID NO: 1501 - RNA, 14 nt, Artificial Sequence
  Synthetic polynucleotide
cacgcagaacaaaa

SEQ ID NO: 1502 - RNA, 14 nt, Artificial Sequence
  Synthetic polynucleotide
cccagaggaagaaa

SEQ ID NO: 1503 - RNA, 16 nt, Artificial Sequence
  Synthetic polynucleotide
cccacaacaggagcag

SEQ ID NO: 1504 - RNA, 20 nt, Artificial Sequence
  Synthetic polynucleotide
caaccucagacagagagcaa

SEQ ID NO: 1505 - RNA, 20 nt, Artificial Sequence
  Synthetic polynucleotide
gaucccaaccucagacagag

SEQ ID NO: 1506 - RNA, 20 nt, Artificial Sequence
  Synthetic polynucleotide
aaauccagccaacaccaggc

SEQ ID NO: 1507 - RNA, 20 nt, Artificial Sequence
  Synthetic polynucleotide
cguguguagucaguguccag

SEQ ID NO: 1508 - RNA, 20 nt, Artificial Sequence
  Synthetic polynucleotide
cguguguagucaguguccag

SEQ ID NO: 1509 - RNA, 20 nt, Artificial Sequence
  Synthetic polynucleotide
guuccacgggucacgaagaa

SEQ ID NO: 1510 - RNA, 20 nt, Artificial Sequence
  Synthetic polynucleotide
aaagccaauuccucgaccag

SEQ ID NO: 1511 - RNA, 20 nt, Artificial Sequence
  Synthetic polynucleotide
ucaguucugcgaucauucag

SEQ ID NO: 1512 - RNA, 20 nt, Artificial Sequence
  Synthetic polynucleotide
gcuccgagucuucaaguugg

SEQ ID NO: 1513 - RNA, 20 nt, Artificial Sequence
  Synthetic polynucleotide
aaucaaaagaagcucuccag

SEQ ID NO: 1514 - RNA, 20 nt, Artificial Sequence
  Synthetic polynucleotide
aauggacagcuucugccaga

SEQ ID NO: 1515 - RNA, 20 nt, Artificial Sequence
  Synthetic polynucleotide
gaauuuuauccaauauggag

SEQ ID NO: 1516 - RNA, 20 nt, Artificial Sequence
  Synthetic polynucleotide
ucuucguucacagauggaag

SEQ ID NO: 1517 - RNA, 20 nt, Artificial Sequence
  Synthetic polynucleotide
guuugugccccacagacccc

SEQ ID NO: 1518 - RNA, 20 nt, Artificial Sequence
  Synthetic polynucleotide
acauuuuugguccaguccgg

SEQ ID NO: 1519 - RNA, 20 nt, Artificial Sequence
  Synthetic polynucleotide
auaggcgagcacaugaaaag

SEQ ID NO: 1520 - RNA, 20 nt, Artificial Sequence
  Synthetic polynucleotide
uacccccaaucagguaccac

SEQ ID NO: 1521 - RNA, 20 nt, Artificial Sequence
  Synthetic polynucleotide
gcaaaucuguaccaccaagg

SEQ ID NO: 1522 - RNA, 20 nt, Artificial Sequence
  Synthetic polynucleotide
aaaagccaauuccucgacca

SEQ ID NO: 1523 - RNA, 20 nt, Artificial Sequence
  Synthetic polynucleotide
uccacgggucacgaagaaaa

SEQ ID NO: 1524 - RNA, 20 nt, Artificial Sequence
  Synthetic polynucleotide
cagccaacaccaggcauugg

SEQ ID NO: 1525 - RNA, 20 nt, Artificial Sequence
  Synthetic polynucleotide
caguuccacgggucacgaag

SEQ ID NO: 1526 - RNA, 20 nt, Artificial Sequence
  Synthetic polynucleotide
cacagaccccaggagcgacg

SEQ ID NO: 1527 - RNA, 20 nt, Artificial Sequence
  Synthetic polynucleotide
uaugugaaacaaaccuuacg

SEQ ID NO: 1528 - RNA, 20 nt, Artificial Sequence
  Synthetic polynucleotide
aaaaauauuccauccuacag

SEQ ID NO: 1529 - RNA, 20 nt, Artificial Sequence
  Synthetic polynucleotide
uuaccaacaggugaguacca

SEQ ID NO: 1530 - RNA, 20 nt, Artificial Sequence
  Synthetic polynucleotide
uuaccaacaggugaguacca

SEQ ID NO: 1531 - RNA, 20 nt, Artificial Sequence
  Synthetic polynucleotide
gccaguuccacgggucacga

SEQ ID NO: 1532 - RNA, 20 nt, Artificial Sequence
  Synthetic polynucleotide
gacauuuuugguccaguccg

SEQ ID NO: 1533 - RNA, 20 nt, Artificial Sequence
  Synthetic polynucleotide
ucagccagaauauaagacac

SEQ ID NO: 1534 - RNA, 20 nt, Artificial Sequence
  Synthetic polynucleotide
caugugccaccgugggagcg

SEQ ID NO: 1535 - RNA, 20 nt, Artificial Sequence
  Synthetic polynucleotide
aucagguaccacccaaauug

SEQ ID NO: 1536 - RNA, 20 nt, Artificial Sequence
  Synthetic polynucleotide
uuaugugaaacaaaccuuac

SEQ ID NO: 1537 - RNA, 20 nt, Artificial Sequence
  Synthetic polynucleotide
accgcuuaaggcaaaauguc

SEQ ID NO: 1538 - RNA, 20 nt, Artificial Sequence
  Synthetic polynucleotide
ggcacgaccaaucaaauaca

SEQ ID NO: 1539 - RNA, 20 nt, Artificial Sequence
  Synthetic polynucleotide
aaugugcgauggaaaaaccu

SEQ ID NO: 1540 - RNA, 20 nt, Artificial Sequence
  Synthetic polynucleotide
cgaauccuacgucuagucaa

SEQ ID NO: 1541 - RNA, 20 nt, Artificial Sequence
  Synthetic polynucleotide
aaacagcugcccuucaucua

SEQ ID NO: 1542 - RNA, 20 nt, Artificial Sequence
  Synthetic polynucleotide
ccagacaaaaauguccaccu

SEQ ID NO: 1543 - RNA, 20 nt, Artificial Sequence
  Synthetic polynucleotide
cauugaacaacgcauugcug

SEQ ID NO: 1544 - RNA, 20 nt, Artificial Sequence
  Synthetic polynucleotide
agaaauaugaacaagacaga

SEQ ID NO: 1545 - RNA, 20 nt, Artificial Sequence
  Synthetic polynucleotide
ggggcuuugauccagucagu

SEQ ID NO: 1546 - RNA, 20 nt, Artificial Sequence
  Synthetic polynucleotide
acagaccccaggagcgacgc

SEQ ID NO: 1547 - RNA, 20 nt, Artificial Sequence
  Synthetic polynucleotide
gagcgacgcagcaguaacau

SEQ ID NO: 1548 - RNA, 20 nt, Artificial Sequence
  Synthetic polynucleotide
cgaauccuacgucuagucaa

SEQ ID NO: 1549 - RNA, 20 nt, Artificial Sequence
  Synthetic polynucleotide
gaauccuacgucuagucaaa

SEQ ID NO: 1550 - RNA, 20 nt, Artificial Sequence
  Synthetic polynucleotide
gcacgaccaaucaaauacac

SEQ ID NO: 1551 - RNA, 20 nt, Artificial Sequence
  Synthetic polynucleotide
ggucaaagucaacauaugac

SEQ ID NO: 1552 - RNA, 20 nt, Artificial Sequence
  Synthetic polynucleotide
guaacaucagccaagccagu

SEQ ID NO: 1553 - RNA, 20 nt, Artificial Sequence
  Synthetic polynucleotide
accuccauacacaaccugac

SEQ ID NO: 1554 - RNA, 20 nt, Artificial Sequence
  Synthetic polynucleotide
auguuagucaaaaugugcga

SEQ ID NO: 1555 - RNA, 20 nt, Artificial Sequence
  Synthetic polynucleotide
ccaaaccucauagaacaucu

SEQ ID NO: 1556 - RNA, 20 nt, Artificial Sequence
  Synthetic polynucleotide
guuuucgaaauucacuugaa

SEQ ID NO: 1557 - RNA, 20 nt, Artificial Sequence
  Synthetic polynucleotide
agccaagccaguaggucccc

SEQ ID NO: 1558 - RNA, 20 nt, Artificial Sequence
  Synthetic polynucleotide
caauggacagcuucugccag

SEQ ID NO: 1559 - RNA, 20 nt, Artificial Sequence
  Synthetic polynucleotide
cauuuuugguccaguccggu

SEQ ID NO: 1560 - RNA, 20 nt, Artificial Sequence
  Synthetic polynucleotide
cagccaguuccacgggucac

SEQ ID NO: 1561 - RNA, 20 nt, Artificial Sequence
  Synthetic polynucleotide
ccaaccucagacagagagca

SEQ ID NO: 1562 - RNA, 20 nt, Artificial Sequence
  Synthetic polynucleotide
aagucaaguuccaaaucguu

SEQ ID NO: 1563 - RNA, 20 nt, Artificial Sequence
  Synthetic polynucleotide
uguuagucaaaaugugcgau

SEQ ID NO: 1564 - RNA, 20 nt, Artificial Sequence
  Synthetic polynucleotide
accuagugacaaaucaagcc

SEQ ID NO: 1565 - RNA, 20 nt, Artificial Sequence
  Synthetic polynucleotide
aauuccucgaccagggguaa

SEQ ID NO: 1566 - RNA, 20 nt, Artificial Sequence
  Synthetic polynucleotide
cccaauggacagcuucugcc

SEQ ID NO: 1567 - RNA, 20 nt, Artificial Sequence
  Synthetic polynucleotide
caaccuccagauugcaguga

SEQ ID NO: 1568 - RNA, 20 nt, Artificial Sequence
  Synthetic polynucleotide
cucaugcugccaaguuaaca

SEQ ID NO: 1569 - RNA, 20 nt, Artificial Sequence
  Synthetic polynucleotide
auaauaaucguccaucccuu

SEQ ID NO: 1570 - RNA, 20 nt, Artificial Sequence
  Synthetic polynucleotide
acagcugcccuucaucuaug

SEQ ID NO: 1571 - RNA, 20 nt, Artificial Sequence
  Synthetic polynucleotide
ggcauaggcgagcacaugaa

SEQ ID NO: 1572 - RNA, 20 nt, Artificial Sequence
  Synthetic polynucleotide
cugcaaggcgaagcagcaga

SEQ ID NO: 1573 - RNA, 20 nt, Artificial Sequence
  Synthetic polynucleotide
ccaaucaaauacacaagaaa

SEQ ID NO: 1574 - RNA, 20 nt, Artificial Sequence
  Synthetic polynucleotide
ccaucccagccagcagaggu

SEQ ID NO: 1575 - RNA, 20 nt, Artificial Sequence
  Synthetic polynucleotide
gcauaggcgagcacaugaaa

SEQ ID NO: 1576 - RNA, 20 nt, Artificial Sequence
  Synthetic polynucleotide
aguucugcgaucauucagac

SEQ ID NO: 1577 - RNA, 20 nt, Artificial Sequence
  Synthetic polynucleotide
gaagcagcagaacaagucuu

SEQ ID NO: 1578 - RNA, 20 nt, Artificial Sequence
  Synthetic polynucleotide
gcuaaugacccaagauuacu

SEQ ID NO: 1579 - RNA, 20 nt, Artificial Sequence
  Synthetic polynucleotide
ggacagcuucugccagaggu

SEQ ID NO: 1580 - RNA, 20 nt, Artificial Sequence
  Synthetic polynucleotide
gugcgauggaaaaaccugaa

SEQ ID NO: 1581 - RNA, 20 nt, Artificial Sequence
  Synthetic polynucleotide
aauauuccauccuacaguga

SEQ ID NO: 1582 - RNA, 20 nt, Artificial Sequence
  Synthetic polynucleotide
uugaacaacgcauugcugaa

SEQ ID NO: 1583 - RNA, 20 nt, Artificial Sequence
  Synthetic polynucleotide
uuaccaacaggugaguacca

SEQ ID NO: 1584 - RNA, 20 nt, Artificial Sequence
  Synthetic polynucleotide
uuaccaacaggugaguacca

SEQ ID NO: 1585 - RNA, 20 nt, Artificial Sequence
  Synthetic polynucleotide
ggaggucgcuggucaagcua

SEQ ID NO: 1586 - RNA, 20 nt, Artificial Sequence
  Synthetic polynucleotide
gccaaguuaacauagaguca

SEQ ID NO: 1587 - RNA, 20 nt, Artificial Sequence
  Synthetic polynucleotide
aaccuccagauugcagugac

SEQ ID NO: 1588 - RNA, 20 nt, Artificial Sequence
  Synthetic polynucleotide
auuccauccuacagugaagu

SEQ ID NO: 1589 - RNA, 20 nt, Artificial Sequence
  Synthetic polynucleotide
gacaaaaauguccaccuugg

SEQ ID NO: 1590 - RNA, 20 nt, Artificial Sequence
  Synthetic polynucleotide
guccagacaaaaauguccac

SEQ ID NO: 1591 - RNA, 20 nt, Artificial Sequence
  Synthetic polynucleotide
uccagaucaagaauuugugu

SEQ ID NO: 1592 - RNA, 20 nt, Artificial Sequence
  Synthetic polynucleotide
augaguauuuccaaguaggc

SEQ ID NO: 1593 - RNA, 20 nt, Artificial Sequence
  Synthetic polynucleotide
caaaagaagcucuccagugg

SEQ ID NO: 1594 - RNA, 20 nt, Artificial Sequence
  Synthetic polynucleotide
auaaccauaugcuauccauu

SEQ ID NO: 1595 - RNA, 20 nt, Artificial Sequence
  Synthetic polynucleotide
auccaaggauguauauuuga

SEQ ID NO: 1596 - RNA, 20 nt, Artificial Sequence
  Synthetic polynucleotide
agucaaguuccaaaucguuc

SEQ ID NO: 1597 - RNA, 20 nt, Artificial Sequence
  Synthetic polynucleotide
aaacagcugcccuucaucua

SEQ ID NO: 1598 - RNA, 20 nt, Artificial Sequence
  Synthetic polynucleotide
uuuaccaacaggugaguacc

SEQ ID NO: 1599 - RNA, 20 nt, Artificial Sequence
  Synthetic polynucleotide
aaggcaacuuuuaagggaug

SEQ ID NO: 1600 - RNA, 20 nt, Artificial Sequence
  Synthetic polynucleotide
ugacaaaucaagccuuugau

SEQ ID NO: 1601 - RNA, 20 nt, Artificial Sequence
  Synthetic polynucleotide
agcuucugccagaggugaua

SEQ ID NO: 1602 - RNA, 20 nt, Artificial Sequence
  Synthetic polynucleotide
ugaacaacgcauugcugaaa

SEQ ID NO: 1603 - RNA, 20 nt, Artificial Sequence
  Synthetic polynucleotide
uaccaacaggugaguaccaa

SEQ ID NO: 1604 - RNA, 20 nt, Artificial Sequence
  Synthetic polynucleotide
uaccaacaggugaguaccaa

SEQ ID NO: 1605 - RNA, 20 nt, Artificial Sequence
  Synthetic polynucleotide
cguucaugugccaccguggg

SEQ ID NO: 1606 - RNA, 20 nt, Artificial Sequence
  Synthetic polynucleotide
aaccuccauacacaaccuga

SEQ ID NO: 1607 - RNA, 20 nt, Artificial Sequence
  Synthetic polynucleotide
uauccauuuuagaagcauuu

SEQ ID NO: 1608 - RNA, 20 nt, Artificial Sequence
  Synthetic polynucleotide
caucccuuaaaaguugccuu

SEQ ID NO: 1609 - RNA, 20 nt, Artificial Sequence
  Synthetic polynucleotide
acaaaagccaauuccucgac

SEQ ID NO: 1610 - RNA, 20 nt, Artificial Sequence
  Synthetic polynucleotide
caaaagccaauuccucgacc

SEQ ID NO: 1611 - RNA, 20 nt, Artificial Sequence
  Synthetic polynucleotide
auugaacaacgcauugcuga

SEQ ID NO: 1612 - RNA, 20 nt, Artificial Sequence
  Synthetic polynucleotide
gauaauuucaaccaacagaa

SEQ ID NO: 1613 - RNA, 20 nt, Artificial Sequence
  Synthetic polynucleotide
uccagucagugaagaagcuu

SEQ ID NO: 1614 - RNA, 20 nt, Artificial Sequence
  Synthetic polynucleotide
aacagaaccaggcaaacauu

SEQ ID NO: 1615 - RNA, 20 nt, Artificial Sequence
  Synthetic polynucleotide
caauggacagcuucugccag

SEQ ID NO: 1616 - RNA, 20 nt, Artificial Sequence
  Synthetic polynucleotide
ccagacaaaaauguccaccu

SEQ ID NO: 1617 - RNA, 20 nt, Artificial Sequence
  Synthetic polynucleotide
cagacaaaaauguccaccuu

SEQ ID NO: 1618 - RNA, 20 nt, Artificial Sequence
  Synthetic polynucleotide
uuagcuccgagucuucaagu

SEQ ID NO: 1619 - RNA, 20 nt, Artificial Sequence
  Synthetic polynucleotide
uucguucacagauggaagaa

SEQ ID NO: 1620 - RNA, 20 nt, Artificial Sequence
  Synthetic polynucleotide
ccaguccgguggguuauuca

SEQ ID NO: 1621 - RNA, 20 nt, Artificial Sequence
  Synthetic polynucleotide
gcauaggcgagcacaugaaa

SEQ ID NO: 1622 - RNA, 20 nt, Artificial Sequence
  Synthetic polynucleotide
gaggucaagacaucuuuaug

SEQ ID NO: 1623 - RNA, 20 nt, Artificial Sequence
  Synthetic polynucleotide
ccauccuacagugaaguagu

SEQ ID NO: 1624 - RNA, 20 nt, Artificial Sequence
  Synthetic polynucleotide
agauaagacaagcagaagau

SEQ ID NO: 1625 - RNA, 20 nt, Artificial Sequence
  Synthetic polynucleotide
gugauggucaaucauuuauu

SEQ ID NO: 1626 - RNA, 20 nt, Artificial Sequence
  Synthetic polynucleotide
aacagcugcccuucaucuau

SEQ ID NO: 1627 - RNA, 20 nt, Artificial Sequence
  Synthetic polynucleotide
guccaguccgguggguuauu

SEQ ID NO: 1628 - RNA, 20 nt, Artificial Sequence
  Synthetic polynucleotide
uguguagucaguguccagag

SEQ ID NO: 1629 - RNA, 20 nt, Artificial Sequence
  Synthetic polynucleotide
aucaaaagaagcucuccagu

SEQ ID NO: 1630 - RNA, 20 nt, Artificial Sequence
  Synthetic polynucleotide
ugccaaguuaacauagaguc

SEQ ID NO: 1631 - RNA, 20 nt, Artificial Sequence
  Synthetic polynucleotide
cuagugacaaaucaagccuu

SEQ ID NO: 1632 - RNA, 20 nt, Artificial Sequence
  Synthetic polynucleotide
ucaugcugccaaguuaacau

SEQ ID NO: 1633 - RNA, 20 nt, Artificial Sequence
  Synthetic polynucleotide
augaguauuuccaaguaggc

SEQ ID NO: 1634 - RNA, 20 nt, Artificial Sequence
  Synthetic polynucleotide
ggcuaaugacccaagauuac

SEQ ID NO: 1635 - RNA, 20 nt, Artificial Sequence
  Synthetic polynucleotide
cucguguguagucagugucc

SEQ ID NO: 1636 - RNA, 20 nt, Artificial Sequence
  Synthetic polynucleotide
auccaauauggagagcaauu

SEQ ID NO: 1637 - RNA, 20 nt, Artificial Sequence
  Synthetic polynucleotide
uucgaacuuucagaguauug

SEQ ID NO: 1638 - RNA, 20 nt, Artificial Sequence
  Synthetic polynucleotide
acagcuguucaugggaaacc

SEQ ID NO: 1639 - RNA, 20 nt, Artificial Sequence
  Synthetic polynucleotide
ucagacagagagcaaugagu

SEQ ID NO: 1640 - RNA, 20 nt, Artificial Sequence
  Synthetic polynucleotide
agucguucaugugccaccgu

SEQ ID NO: 1641 - RNA, 20 nt, Artificial Sequence
  Synthetic polynucleotide
aagguuuucccaguaaucuu

SEQ ID NO: 1642 - RNA, 20 nt, Artificial Sequence
  Synthetic polynucleotide
uaaaggcaacuuuuaaggga

SEQ ID NO: 1643 - RNA, 20 nt, Artificial Sequence
  Synthetic polynucleotide
ugugccaccgugggagcgua

SEQ ID NO: 1644 - RNA, 20 nt, Artificial Sequence
  Synthetic polynucleotide
uugaauuuuauccaauaugg

SEQ ID NO: 1645 - RNA, 20 nt, Artificial Sequence
  Synthetic polynucleotide
caaaaauauuccagccuacu

SEQ ID NO: 1646 - RNA, 20 nt, Artificial Sequence
  Synthetic polynucleotide
gauaagacaagcagaagauc

SEQ ID NO: 1647 - RNA, 20 nt, Artificial Sequence
  Synthetic polynucleotide
ucuucgaacuuucagaguau

SEQ ID NO: 1648 - RNA, 20 nt, Artificial Sequence
  Synthetic polynucleotide
ggacacugacuacacacgag

SEQ ID NO: 1649 - RNA, 20 nt, Artificial Sequence
  Synthetic polynucleotide
ccaaugcugccggugaacgg

SEQ ID NO: 1650 - RNA, 20 nt, Artificial Sequence
  Synthetic polynucleotide
ugugccccacagaccccagg

SEQ ID NO: 1651 - RNA, 20 nt, Artificial Sequence
  Synthetic polynucleotide
gauuccaguaaagaccuaag

SEQ ID NO: 1652 - RNA, 20 nt, Artificial Sequence
  Synthetic polynucleotide
gaucccaaccucagacagag

SEQ ID NO: 1653 - RNA, 20 nt, Artificial Sequence
  Synthetic polynucleotide
ucuccacacagcacgcggaa

SEQ ID NO: 1654 - RNA, 20 nt, Artificial Sequence
  Synthetic polynucleotide
ccacccgacugugacccaaa

SEQ ID NO: 1655 - RNA, 20 nt, Artificial Sequence
  Synthetic polynucleotide
guguccccuacccuguuccg

SEQ ID NO: 1656 - RNA, 20 nt, Artificial Sequence
  Synthetic polynucleotide
gacccugaugcaaacaaccu

SEQ ID NO: 1657 - RNA, 20 nt, Artificial Sequence
  Synthetic polynucleotide
guuugugccccacagacccc

SEQ ID NO: 1658 - RNA, 20 nt, Artificial Sequence
  Synthetic polynucleotide
uacccccaaucagguaccac

SEQ ID NO: 1659 - RNA, 20 nt, Artificial Sequence
  Synthetic polynucleotide
guguccccuacccuguuccg

SEQ ID NO: 1660 - RNA, 20 nt, Artificial Sequence
  Synthetic polynucleotide
aaaagccaauuccucgacca

SEQ ID NO: 1661 - RNA, 20 nt, Artificial Sequence
  Synthetic polynucleotide
auaacccuuugccuggagaa

SEQ ID NO: 1662 - RNA, 20 nt, Artificial Sequence
  Synthetic polynucleotide
ucuccuuucaguccucuaag

SEQ ID NO: 1663 - RNA, 20 nt, Artificial Sequence
  Synthetic polynucleotide
guaaucccagguaagaagua

SEQ ID NO: 1664 - RNA, 20 nt, Artificial Sequence
  Synthetic polynucleotide
gaaguuugaucccgaugcga

SEQ ID NO: 1665 - RNA, 20 nt, Artificial Sequence
  Synthetic polynucleotide
aaccacaaaggagagcaucu

SEQ ID NO: 1666 - RNA, 20 nt, Artificial Sequence
  Synthetic polynucleotide
gaaacaggccucuggcucau

SEQ ID NO: 1667 - RNA, 20 nt, Artificial Sequence
  Synthetic polynucleotide
acccuuugccuggagaagga

SEQ ID NO: 1668 - RNA, 20 nt, Artificial Sequence
  Synthetic polynucleotide
gauuccaguaaagaccuaag

SEQ ID NO: 1669 - RNA, 20 nt, Artificial Sequence
  Synthetic polynucleotide
cugaaccuaugaauuccgau

SEQ ID NO: 1670 - RNA, 20 nt, Artificial Sequence
  Synthetic polynucleotide
guccccaccaaugcugccgg

SEQ ID NO: 1671 - RNA, 20 nt, Artificial Sequence
  Synthetic polynucleotide
agguccccaccaaugcugcc

SEQ ID NO: 1672 - RNA, 20 nt, Artificial Sequence
  Synthetic polynucleotide
caccuggggaauccgauuug

SEQ ID NO: 1673 - RNA, 20 nt, Artificial Sequence
  Synthetic polynucleotide
auaaggcacauagcuugacc

SEQ ID NO: 1674 - RNA, 20 nt, Artificial Sequence
  Synthetic polynucleotide
aaacccugauuauggcuaca

SEQ ID NO: 1675 - RNA, 20 nt, Artificial Sequence
  Synthetic polynucleotide
cacagaccccaggagcgacg

SEQ ID NO: 1676 - RNA, 20 nt, Artificial Sequence
  Synthetic polynucleotide
gaccccuacuaugcagacaa

SEQ ID NO: 1677 - RNA, 20 nt, Artificial Sequence
  Synthetic polynucleotide
ccccuacuaugcagacaaaa

SEQ ID NO: 1678 - RNA, 20 nt, Artificial Sequence
  Synthetic polynucleotide
aaacagcugcccuucaucua

SEQ ID NO: 1679 - RNA, 20 nt, Artificial Sequence
  Synthetic polynucleotide
ggguccaagaagccacaaaa

SEQ ID NO: 1680 - RNA, 20 nt, Artificial Sequence
  Synthetic polynucleotide
acagaccccaggagcgacgc

SEQ ID NO: 1681 - RNA, 20 nt, Artificial Sequence
  Synthetic polynucleotide
cuggacacugacuacacacg

SEQ ID NO: 1682 - RNA, 20 nt, Artificial Sequence
  Synthetic polynucleotide
ugacaauccuuccacaucug

SEQ ID NO: 1683 - RNA, 20 nt, Artificial Sequence
  Synthetic polynucleotide
agacagauaagaaccaugau

SEQ ID NO: 1684 - RNA, 20 nt, Artificial Sequence
  Synthetic polynucleotide
uccuggccaacauugaacau

SEQ ID NO: 1685 - RNA, 20 nt, Artificial Sequence
  Synthetic polynucleotide
uggggacauuccucccggca

SEQ ID NO: 1686 - RNA, 20 nt, Artificial Sequence
  Synthetic polynucleotide
auaacccaccggacuggacc

SEQ ID NO: 1687 - RNA, 20 nt, Artificial Sequence
  Synthetic polynucleotide
caguugauaacccuuugccu

SEQ ID NO: 1688 - RNA, 20 nt, Artificial Sequence
  Synthetic polynucleotide
aguguccagagggguacacc

SEQ ID NO: 1689 - RNA, 20 nt, Artificial Sequence
  Synthetic polynucleotide
ccaugaauaacccaccggac

SEQ ID NO: 1690 - RNA, 20 nt, Artificial Sequence
  Synthetic polynucleotide
gugacagugccaauugcacc

SEQ ID NO: 1691 - RNA, 20 nt, Artificial Sequence
  Synthetic polynucleotide
aauuccucgaccagggguaa

SEQ ID NO: 1692 - RNA, 20 nt, Artificial Sequence
  Synthetic polynucleotide
ugggguccaagaagccacaa

SEQ ID NO: 1693 - RNA, 20 nt, Artificial Sequence
  Synthetic polynucleotide
ugacagugccaauugcaccu

SEQ ID NO: 1694 - RNA, 20 nt, Artificial Sequence
  Synthetic polynucleotide
caaaaagccaaagauuucca

SEQ ID NO: 1695 - RNA, 20 nt, Artificial Sequence
  Synthetic polynucleotide
uugcuccuuugacuagacgu

SEQ ID NO: 1696 - RNA, 20 nt, Artificial Sequence
  Synthetic polynucleotide
aaaauguccaccuugguggu

SEQ ID NO: 1697 - RNA, 20 nt, Artificial Sequence
  Synthetic polynucleotide
auaaauaugcaguuugucag

SEQ ID NO: 1698 - RNA, 20 nt, Artificial Sequence
  Synthetic polynucleotide
cacaaucccagccucacagu

SEQ ID NO: 1699 - RNA, 20 nt, Artificial Sequence
  Synthetic polynucleotide
uuugcuccuuugacuagacg

SEQ ID NO: 1700 - RNA, 20 nt, Artificial Sequence
  Synthetic polynucleotide
aguagguccccaccaaugcu

SEQ ID NO: 1701 - RNA, 20 nt, Artificial Sequence
  Synthetic polynucleotide
caaaagccaauuccucgacc

SEQ ID NO: 1702 - RNA, 20 nt, Artificial Sequence
  Synthetic polynucleotide
acagcugcccuucaucuaug

SEQ ID NO: 1703 - RNA, 20 nt, Artificial Sequence
  Synthetic polynucleotide
acaguugauaacccuuugcc

SEQ ID NO: 1704 - RNA, 20 nt, Artificial Sequence
  Synthetic polynucleotide
uagguccccaccaaugcugc

SEQ ID NO: 1705 - RNA, 20 nt, Artificial Sequence
  Synthetic polynucleotide
gcugaaccuaugaauuccga

SEQ ID NO: 1706 - RNA, 20 nt, Artificial Sequence
  Synthetic polynucleotide
agccagaggccuguuucaca

SEQ ID NO: 1707 - RNA, 20 nt, Artificial Sequence
  Synthetic polynucleotide
gacagugccaauugcaccug

SEQ ID NO: 1708 - RNA, 20 nt, Artificial Sequence
  Synthetic polynucleotide
gauaacccuuugccuggaga

SEQ ID NO: 1709 - RNA, 20 nt, Artificial Sequence
  Synthetic polynucleotide
ccaccucuccaccuucauau

SEQ ID NO: 1710 - RNA, 20 nt, Artificial Sequence
  Synthetic polynucleotide
caaaagccaauuccucgacc

SEQ ID NO: 1711 - RNA, 20 nt, Artificial Sequence
  Synthetic polynucleotide
gguuuccugcaagucaaguu

SEQ ID NO: 1712 - RNA, 20 nt, Artificial Sequence
  Synthetic polynucleotide
gaaacaggccucuggcucau

SEQ ID NO: 1713 - RNA, 20 nt, Artificial Sequence
  Synthetic polynucleotide
cauccuggaaguucaguuga

SEQ ID NO: 1714 - RNA, 20 nt, Artificial Sequence
  Synthetic polynucleotide
gcaaaacauucggaacgauu

SEQ ID NO: 1715 - RNA, 20 nt, Artificial Sequence
  Synthetic polynucleotide
ccucugagugaggaugacuu

SEQ ID NO: 1716 - RNA, 20 nt, Artificial Sequence
  Synthetic polynucleotide
cagcugcccuucaucuaugg

SEQ ID NO: 1717 - RNA, 20 nt, Artificial Sequence
  Synthetic polynucleotide
uauuccaacagauggguuac

SEQ ID NO: 1718 - RNA, 20 nt, Artificial Sequence
  Synthetic polynucleotide
gcaccuggggaauccgauuu

SEQ ID NO: 1719 - RNA, 20 nt, Artificial Sequence
  Synthetic polynucleotide
auaacccuuugccuggagaa

SEQ ID NO: 1720 - RNA, 20 nt, Artificial Sequence
  Synthetic polynucleotide
uucgugacccguggaacugg

SEQ ID NO: 1721 - RNA, 20 nt, Artificial Sequence
  Synthetic polynucleotide
aggcaaaucauacuguugcc

SEQ ID NO: 1722 - RNA, 20 nt, Artificial Sequence
  Synthetic polynucleotide
aaucccagguaagaaguaau

SEQ ID NO: 1723 - RNA, 20 nt, Artificial Sequence
  Synthetic polynucleotide
ucacacagguguaccccucu

SEQ ID NO: 1724 - RNA, 20 nt, Artificial Sequence
  Synthetic polynucleotide
auuccauccuacagugaagu

SEQ ID NO: 1725 - RNA, 20 nt, Artificial Sequence
  Synthetic polynucleotide
cucuggacacugacuacaca

SEQ ID NO: 1726 - RNA, 20 nt, Artificial Sequence
  Synthetic polynucleotide
ugcuccuuugacuagacgua

SEQ ID NO: 1727 - RNA, 20 nt, Artificial Sequence
  Synthetic polynucleotide
auuucgaaaacauuuaugcu

SEQ ID NO: 1728 - RNA, 20 nt, Artificial Sequence
  Synthetic polynucleotide
ugcaccuggggaauccgauu

SEQ ID NO: 1729 - RNA, 20 nt, Artificial Sequence
  Synthetic polynucleotide
augaucccaaccucagacag

SEQ ID NO: 1730 - RNA, 20 nt, Artificial Sequence
  Synthetic polynucleotide
aaaaagccaaagauuuccag

SEQ ID NO: 1731 - RNA, 20 nt, Artificial Sequence
  Synthetic polynucleotide
gugacagugccaauugcacc

SEQ ID NO: 1732 - RNA, 20 nt, Artificial Sequence
  Synthetic polynucleotide
ccaccaaugcugccggugaa

SEQ ID NO: 1733 - RNA, 20 nt, Artificial Sequence
  Synthetic polynucleotide
gcaauuccuuccaucaugaa

SEQ ID NO: 1734 - RNA, 20 nt, Artificial Sequence
  Synthetic polynucleotide
cagucaccacucagcauucg

SEQ ID NO: 1735 - RNA, 20 nt, Artificial Sequence
  Synthetic polynucleotide
aagaccucuaagagccuuau

SEQ ID NO: 1736 - RNA, 20 nt, Artificial Sequence
  Synthetic polynucleotide
aaacagcugcccuucaucua

SEQ ID NO: 1737 - RNA, 20 nt, Artificial Sequence
  Synthetic polynucleotide
ucaaaggaacccaaagaaga

SEQ ID NO: 1738 - RNA, 20 nt, Artificial Sequence
  Synthetic polynucleotide
uggggacauuccucccggca

SEQ ID NO: 1739 - RNA, 20 nt, Artificial Sequence
  Synthetic polynucleotide
agcuucugccagaggugaua

SEQ ID NO: 1740 - RNA, 20 nt, Artificial Sequence
  Synthetic polynucleotide
auggaucugcccaugguuag

SEQ ID NO: 1741 - RNA, 20 nt, Artificial Sequence
  Synthetic polynucleotide
uucacacagguguaccccuc

SEQ ID NO: 1742 - RNA, 20 nt, Artificial Sequence
  Synthetic polynucleotide
uccauccuacagugaaguag

SEQ ID NO: 1743 - RNA, 20 nt, Artificial Sequence
  Synthetic polynucleotide
caaaagccaauuccucgacc

SEQ ID NO: 1744 - RNA, 20 nt, Artificial Sequence
  Synthetic polynucleotide
agacacacaaguagcacauu

SEQ ID NO: 1745 - RNA, 20 nt, Artificial Sequence
  Synthetic polynucleotide
acaaaagccaauuccucgac

SEQ ID NO: 1746 - RNA, 20 nt, Artificial Sequence
  Synthetic polynucleotide
cccaugaugcugaauaucag

SEQ ID NO: 1747 - RNA, 20 nt, Artificial Sequence
  Synthetic polynucleotide
gacccaaaaaaaguucaucc

SEQ ID NO: 1748 - RNA, 20 nt, Artificial Sequence
  Synthetic polynucleotide
uuugugccccacagacccca

SEQ ID NO: 1749 - RNA, 20 nt, Artificial Sequence
  Synthetic polynucleotide
uuugcuccuuugacuagacg

SEQ ID NO: 1750 - RNA, 20 nt, Artificial Sequence
  Synthetic polynucleotide
ccucuaagaagaauaucuau

SEQ ID NO: 1751 - RNA, 20 nt, Artificial Sequence
  Synthetic polynucleotide
auggauccauaugaguauuu

SEQ ID NO: 1752 - RNA, 20 nt, Artificial Sequence
  Synthetic polynucleotide
uuggccccauuaaaucccuu

SEQ ID NO: 1753 - RNA, 20 nt, Artificial Sequence
  Synthetic polynucleotide
cuuugacuagacguaggauu

SEQ ID NO: 1754 - RNA, 20 nt, Artificial Sequence
  Synthetic polynucleotide
uucuccuuucaguccucuaa

SEQ ID NO: 1755 - RNA, 20 nt, Artificial Sequence
  Synthetic polynucleotide
aauaaggcacauagcuugac

SEQ ID NO: 1756 - RNA, 20 nt, Artificial Sequence
  Synthetic polynucleotide
aacuaugcaaaugguaauug

SEQ ID NO: 1757 - RNA, 20 nt, Artificial Sequence
  Synthetic polynucleotide
caccaaugcugccggugaac

SEQ ID NO: 1758 - RNA, 20 nt, Artificial Sequence
  Synthetic polynucleotide
auggaucugcccaugguuag

SEQ ID NO: 1759 - RNA, 20 nt, Artificial Sequence
  Synthetic polynucleotide
ugccaauugcaccuggggaa

SEQ ID NO: 1760 - RNA, 20 nt, Artificial Sequence
  Synthetic polynucleotide
aauguccaccuuggugguac

SEQ ID NO: 1761 - RNA, 20 nt, Artificial Sequence
  Synthetic polynucleotide
guugccucccccaggaccuc

SEQ ID NO: 1762 - RNA, 20 nt, Artificial Sequence
  Synthetic polynucleotide
ccauggaucugcccaugguu

SEQ ID NO: 1763 - RNA, 20 nt, Artificial Sequence
  Synthetic polynucleotide
cucuggacacugacuacaca

SEQ ID NO: 1764 - RNA, 20 nt, Artificial Sequence
  Synthetic polynucleotide
aacagcugcccuucaucuau

SEQ ID NO: 1765 - RNA, 20 nt, Artificial Sequence
  Synthetic polynucleotide
gcuuucuccuuucaguccuc

SEQ ID NO: 1766 - RNA, 20 nt, Artificial Sequence
  Synthetic polynucleotide
cgugacccguggaacuggcu

SEQ ID NO: 1767 - RNA, 20 nt, Artificial Sequence
  Synthetic polynucleotide
auggauccuuuuguagaucu

SEQ ID NO: 1768 - RNA, 20 nt, Artificial Sequence
  Synthetic polynucleotide
auccuggaaguucaguugaa

SEQ ID NO: 1769 - RNA, 20 nt, Artificial Sequence
  Synthetic polynucleotide
aagccccuacaauugucuuc

SEQ ID NO: 1770 - RNA, 20 nt, Artificial Sequence
  Synthetic polynucleotide
uggaucugcccaugguuagu

SEQ ID NO: 1771 - RNA, 20 nt, Artificial Sequence
  Synthetic polynucleotide
aaguuggacauuccaaagau

SEQ ID NO: 1772 - RNA, 20 nt, Artificial Sequence
  Synthetic polynucleotide
gauaacccuuugccuggaga

SEQ ID NO: 1773 - RNA, 20 nt, Artificial Sequence
  Synthetic polynucleotide
augagccagaggccuguuuc

SEQ ID NO: 1774 - RNA, 20 nt, Artificial Sequence
  Synthetic polynucleotide
cauccuggaaguucaguuga

SEQ ID NO: 1775 - RNA, 20 nt, Artificial Sequence
  Synthetic polynucleotide
agugcacaugaugagcaugc

SEQ ID NO: 1776 - RNA, 20 nt, Artificial Sequence
  Synthetic polynucleotide
gcacacauucuccagugaaa

SEQ ID NO: 1777 - RNA, 20 nt, Artificial Sequence
  Synthetic polynucleotide
ccauacacaaccugacaaga

SEQ ID NO: 1778 - RNA, 20 nt, Artificial Sequence
  Synthetic polynucleotide
uacgcucccacgguggcaca

SEQ ID NO: 1779 - RNA, 20 nt, Artificial Sequence
  Synthetic polynucleotide
accacaaaggagagcaucuu

SEQ ID NO: 1780 - RNA, 20 nt, Artificial Sequence
  Synthetic polynucleotide
acagucggguggcuuacugu

SEQ ID NO: 1781 - RNA, 20 nt, Artificial Sequence
  Synthetic polynucleotide
cuggccaacauugaacaugc

SEQ ID NO: 1782 - RNA, 20 nt, Artificial Sequence
  Synthetic polynucleotide
cugcccaugguuagugguga

SEQ ID NO: 1783 - RNA, 20 nt, Artificial Sequence
  Synthetic polynucleotide
uucgaaaacauuuaugcuuc

SEQ ID NO: 1784 - RNA, 20 nt, Artificial Sequence
  Synthetic polynucleotide
gcagcacgcagcgucuaggg

SEQ ID NO: 1785 - RNA, 20 nt, Artificial Sequence
  Synthetic polynucleotide
gcagcacgcagcgucuaggg

SEQ ID NO: 1786 - RNA, 20 nt, Artificial Sequence
  Synthetic polynucleotide
guuuaggaccuauaucaggg

SEQ ID NO: 1787 - RNA, 20 nt, Artificial Sequence
  Synthetic polynucleotide
gauuccaguaaagaccuaag

SEQ ID NO: 1788 - RNA, 20 nt, Artificial Sequence
  Synthetic polynucleotide
acuuacaacuugaagcagag

SEQ ID NO: 1789 - RNA, 20 nt, Artificial Sequence
  Synthetic polynucleotide
gcuagaaacauaccuguaug

SEQ ID NO: 1790 - RNA, 20 nt, Artificial Sequence
  Synthetic polynucleotide
accagggcaccacugcugag

SEQ ID NO: 1791 - RNA, 20 nt, Artificial Sequence
  Synthetic polynucleotide
aaccuccauacacaaccuga

SEQ ID NO: 1792 - RNA, 20 nt, Artificial Sequence
  Synthetic polynucleotide
guuuaggaccuauaucaggg

SEQ ID NO: 1793 - RNA, 20 nt, Artificial Sequence
  Synthetic polynucleotide
aacgaccuaguauucaaaag

SEQ ID NO: 1794 - RNA, 20 nt, Artificial Sequence
  Synthetic polynucleotide
uuacgcaaaaacaaugacga

SEQ ID NO: 1795 - RNA, 20 nt, Artificial Sequence
  Synthetic polynucleotide
ccaguaaagaccuaagugag

SEQ ID NO: 1796 - RNA, 20 nt, Artificial Sequence
  Synthetic polynucleotide
gacacugacuacacacgaga

SEQ ID NO: 1797 - RNA, 20 nt, Artificial Sequence
  Synthetic polynucleotide
ugucuucaggccugaaaaug

SEQ ID NO: 1798 - RNA, 20 nt, Artificial Sequence
  Synthetic polynucleotide
uuaccagucugaaugaucgc

SEQ ID NO: 1799 - RNA, 20 nt, Artificial Sequence
  Synthetic polynucleotide
cguccuuacgcugucaucag

SEQ ID NO: 1800 - RNA, 20 nt, Artificial Sequence
  Synthetic polynucleotide
acucgacauuuuugguccag

SEQ ID NO: 1801 - RNA, 20 nt, Artificial Sequence
  Synthetic polynucleotide
uuccaguaaagaccuaagug

SEQ ID NO: 1802 - RNA, 20 nt, Artificial Sequence
  Synthetic polynucleotide
gauuccaguaaagaccuaag

SEQ ID NO: 1803 - RNA, 20 nt, Artificial Sequence
  Synthetic polynucleotide
ggucgugcccuaaaaaaaaa

SEQ ID NO: 1804 - RNA, 20 nt, Artificial Sequence
  Synthetic polynucleotide
uagguuuaggaccuauauca

SEQ ID NO: 1805 - RNA, 20 nt, Artificial Sequence
  Synthetic polynucleotide
ggaccuauaucagggugggg

SEQ ID NO: 1806 - RNA, 20 nt, Artificial Sequence
  Synthetic polynucleotide
agguuuaggaccuauaucag

SEQ ID NO: 1807 - RNA, 20 nt, Artificial Sequence
  Synthetic polynucleotide
acacugacuacacacgagaa

SEQ ID NO: 1808 - RNA, 20 nt, Artificial Sequence
  Synthetic polynucleotide
guaaagaccuaagugagaaa

SEQ ID NO: 1809 - RNA, 20 nt, Artificial Sequence
  Synthetic polynucleotide
acgcagcgucuagggaaaaa

SEQ ID NO: 1810 - RNA, 20 nt, Artificial Sequence
  Synthetic polynucleotide
uuacuugcaaccuagcccgc

SEQ ID NO: 1811 - RNA, 20 nt, Artificial Sequence
  Synthetic polynucleotide
ggacacuuacaacuugaagc

SEQ ID NO: 1812 - RNA, 20 nt, Artificial Sequence
  Synthetic polynucleotide
gauuggucgugcccuaaaaa

SEQ ID NO: 1813 - RNA, 20 nt, Artificial Sequence
  Synthetic polynucleotide
cuggacacugacuacacacg

SEQ ID NO: 1814 - RNA, 20 nt, Artificial Sequence
  Synthetic polynucleotide
aaacauaccuguauguggag

SEQ ID NO: 1815 - RNA, 20 nt, Artificial Sequence
  Synthetic polynucleotide
uuuaccagucugaaugaucg

SEQ ID NO: 1816 - RNA, 20 nt, Artificial Sequence
  Synthetic polynucleotide
accuauaucaggguggggag

SEQ ID NO: 1817 - RNA, 20 nt, Artificial Sequence
  Synthetic polynucleotide
uuaggaccuauaucagggug

SEQ ID NO: 1818 - RNA, 20 nt, Artificial Sequence
  Synthetic polynucleotide
ucacaacgaccuaguauuca

SEQ ID NO: 1819 - RNA, 20 nt, Artificial Sequence
  Synthetic polynucleotide
uuguucugcaaagaaauaag

SEQ ID NO: 1820 - RNA, 20 nt, Artificial Sequence
  Synthetic polynucleotide
ccuguauguggaggaaaaua

SEQ ID NO: 1821 - RNA, 20 nt, Artificial Sequence
  Synthetic polynucleotide
aaaacguccuuacgcuguca

SEQ ID NO: 1822 - RNA, 20 nt, Artificial Sequence
  Synthetic polynucleotide
ucuucaggccugaaaauggg

SEQ ID NO: 1823 - RNA, 20 nt, Artificial Sequence
  Synthetic polynucleotide
uauuuuuuuaccccuggucg

SEQ ID NO: 1824 - RNA, 20 nt, Artificial Sequence
  Synthetic polynucleotide
acuuacuugcaaccuagccc

SEQ ID NO: 1825 - RNA, 20 nt, Artificial Sequence
  Synthetic polynucleotide
auuuuuuuaccccuggucga

SEQ ID NO: 1826 - RNA, 20 nt, Artificial Sequence
  Synthetic polynucleotide
uacuaugaaagucugcagga

SEQ ID NO: 1827 - RNA, 20 nt, Artificial Sequence
  Synthetic polynucleotide
aauauucuuaccuacaaugg

SEQ ID NO: 1828 - RNA, 20 nt, Artificial Sequence
  Synthetic polynucleotide
accuaaacacaagauuccau

SEQ ID NO: 1829 - RNA, 20 nt, Artificial Sequence
  Synthetic polynucleotide
agaggccuggauggaaacaa

SEQ ID NO: 1830 - RNA, 20 nt, Artificial Sequence
  Synthetic polynucleotide
aguaccuacaucaacaauua

SEQ ID NO: 1831 - RNA, 20 nt, Artificial Sequence
  Synthetic polynucleotide
gacacuuacaacuugaagca

SEQ ID NO: 1832 - RNA, 20 nt, Artificial Sequence
  Synthetic polynucleotide
ccauacacaaccugacaaga

SEQ ID NO: 1833 - RNA, 20 nt, Artificial Sequence
  Synthetic polynucleotide
cgcagcgucuagggaaaaau

SEQ ID NO: 1834 - RNA, 20 nt, Artificial Sequence
  Synthetic polynucleotide
gagacuuaccaaauuuccua

SEQ ID NO: 1835 - RNA, 20 nt, Artificial Sequence
  Synthetic polynucleotide
uugucuucaggccugaaaau

SEQ ID NO: 1836 - RNA, 20 nt, Artificial Sequence
  Synthetic polynucleotide
uucuuaccugggauuacaga

SEQ ID NO: 1837 - RNA, 20 nt, Artificial Sequence
  Synthetic polynucleotide
uuuaggaccuauaucagggu

SEQ ID NO: 1838 - RNA, 20 nt, Artificial Sequence
  Synthetic polynucleotide
aacguccuuacgcugucauc

SEQ ID NO: 1839 - RNA, 20 nt, Artificial Sequence
  Synthetic polynucleotide
aggaccuauaucaggguggg

SEQ ID NO: 1840 - RNA, 20 nt, Artificial Sequence
  Synthetic polynucleotide
uuaggaccuauaucagggug

SEQ ID NO: 1841 - RNA, 20 nt, Artificial Sequence
  Synthetic polynucleotide
ugucuucaggccugaaaaug

SEQ ID NO: 1842 - RNA, 20 nt, Artificial Sequence
  Synthetic polynucleotide
auaaauauucuuaccuacaa

SEQ ID NO: 1843 - RNA, 20 nt, Artificial Sequence
  Synthetic polynucleotide
cauaccuguauguggaggaa

SEQ ID NO: 1844 - RNA, 20 nt, Artificial Sequence
  Synthetic polynucleotide
guuuaccagucugaaugauc

SEQ ID NO: 1845 - RNA, 20 nt, Artificial Sequence
  Synthetic polynucleotide
gauuauuacauaccuuccac

SEQ ID NO: 1846 - RNA, 20 nt, Artificial Sequence
  Synthetic polynucleotide
ucaccuuuuugucugcauag

SEQ ID NO: 1847 - RNA, 20 nt, Artificial Sequence
  Synthetic polynucleotide
augaaagucugcaggaggaa

SEQ ID NO: 1848 - RNA, 20 nt, Artificial Sequence
  Synthetic polynucleotide
aaacguccuuacgcugucau

SEQ ID NO: 1849 - RNA, 20 nt, Artificial Sequence
  Synthetic polynucleotide
cacuuacucgacauuuuugg

SEQ ID NO: 1850 - RNA, 20 nt, Artificial Sequence
  Synthetic polynucleotide
cuugguacucaccuguuggu

SEQ ID NO: 1851 - RNA, 20 nt, Artificial Sequence
  Synthetic polynucleotide
gcaauugccugguugggcca

SEQ ID NO: 1852 - RNA, 20 nt, Artificial Sequence
  Synthetic polynucleotide
aacguccuuacgcugucauc

SEQ ID NO: 1853 - RNA, 20 nt, Artificial Sequence
  Synthetic polynucleotide
cauacacaaccugacaagaa

SEQ ID NO: 1854 - RNA, 20 nt, Artificial Sequence
  Synthetic polynucleotide
aaguucugggagaaaaaagc

SEQ ID NO: 1855 - RNA, 20 nt, Artificial Sequence
  Synthetic polynucleotide
ugguuacauaccaccagguu

SEQ ID NO: 1856 - RNA, 20 nt, Artificial Sequence
  Synthetic polynucleotide
ugccuuuaagaauaacauua

SEQ ID NO: 1857 - RNA, 20 nt, Artificial Sequence
  Synthetic polynucleotide
uaagaggccuggauggaaac

SEQ ID NO: 1858 - RNA, 20 nt, Artificial Sequence
  Synthetic polynucleotide
ggacacuuacaacuugaagc

SEQ ID NO: 1859 - RNA, 20 nt, Artificial Sequence
  Synthetic polynucleotide
uauuuuuuuaccccuggucg

SEQ ID NO: 1860 - RNA, 20 nt, Artificial Sequence
  Synthetic polynucleotide
auacccacuuacucgacauu

SEQ ID NO: 1861 - RNA, 20 nt, Artificial Sequence
  Synthetic polynucleotide
cuuacucgacauuuuugguc

SEQ ID NO: 1862 - RNA, 20 nt, Artificial Sequence
  Synthetic polynucleotide
ugguacucaccuguugguaa

SEQ ID NO: 1863 - RNA, 20 nt, Artificial Sequence
  Synthetic polynucleotide
aauagguuuaggaccuauau

SEQ ID NO: 1864 - RNA, 20 nt, Artificial Sequence
  Synthetic polynucleotide
acaacgaccuaguauucaaa

SEQ ID NO: 1865 - RNA, 20 nt, Artificial Sequence
  Synthetic polynucleotide
gccuuuaagaauaacauuaa

SEQ ID NO: 1866 - RNA, 20 nt, Artificial Sequence
  Synthetic polynucleotide
gggugguaccugauuggggg

SEQ ID NO: 1867 - RNA, 20 nt, Artificial Sequence
  Synthetic polynucleotide
acgaccuaguauucaaaaga

SEQ ID NO: 1868 - RNA, 20 nt, Artificial Sequence
  Synthetic polynucleotide
gaaacauaccuguaugugga

SEQ ID NO: 1869 - RNA, 20 nt, Artificial Sequence
  Synthetic polynucleotide
uaaacucaccuuuuugucug

SEQ ID NO: 1870 - RNA, 20 nt, Artificial Sequence
  Synthetic polynucleotide
uacauacccugaaucugugc

SEQ ID NO: 1871 - RNA, 20 nt, Artificial Sequence
  Synthetic polynucleotide
cuagaaacauaccuguaugu

SEQ ID NO: 1872 - RNA, 20 nt, Artificial Sequence
  Synthetic polynucleotide
cgaccuaguauucaaaagaa

SEQ ID NO: 1873 - RNA, 20 nt, Artificial Sequence
  Synthetic polynucleotide
aaguugccuuuaagaauaac

SEQ ID NO: 1874 - RNA, 20 nt, Artificial Sequence
  Synthetic polynucleotide
ggugguaccugauugggggu

SEQ ID NO: 1875 - RNA, 20 nt, Artificial Sequence
  Synthetic polynucleotide
caccuuuuugucugcauagu

SEQ ID NO: 1876 - RNA, 20 nt, Artificial Sequence
  Synthetic polynucleotide
accuaaacacaagauuccau

SEQ ID NO: 1877 - RNA, 20 nt, Artificial Sequence
  Synthetic polynucleotide
cgcagcgucuagggaaaaau

SEQ ID NO: 1878 - RNA, 20 nt, Artificial Sequence
  Synthetic polynucleotide
aauuugggugguaccugauu

SEQ ID NO: 1879 - RNA, 20 nt, Artificial Sequence
  Synthetic polynucleotide
ccuuuuugucugcauaguag

SEQ ID NO: 1880 - RNA, 20 nt, Artificial Sequence
  Synthetic polynucleotide
uuuaccccuggucgaggaau

SEQ ID NO: 1881 - RNA, 20 nt, Artificial Sequence
  Synthetic polynucleotide
uacuuacgcaaaaacaauga

SEQ ID NO: 1882 - RNA, 20 nt, Artificial Sequence
  Synthetic polynucleotide
ccuauaucaggguggggaga

SEQ ID NO: 1883 - RNA, 20 nt, Artificial Sequence
  Synthetic polynucleotide
aauuugggugguaccugauu

SEQ ID NO: 1884 - RNA, 20 nt, Artificial Sequence
  Synthetic polynucleotide
uugguacucaccuguuggua

SEQ ID NO: 1885 - RNA, 20 nt, Artificial Sequence
  Synthetic polynucleotide
auuuaccagggcaccacugc

SEQ ID NO: 1886 - RNA, 20 nt, Artificial Sequence
  Synthetic polynucleotide
acauaccuuccacaguguuu

SEQ ID NO: 1887 - RNA, 20 nt, Artificial Sequence
  Synthetic polynucleotide
caccuguugguaaagguuuu

SEQ ID NO: 1888 - RNA, 20 nt, Artificial Sequence
  Synthetic polynucleotide
gacuuaccaaauuuccuaua

SEQ ID NO: 1889 - RNA, 20 nt, Artificial Sequence
  Synthetic polynucleotide
acacuuacaacuugaagcag

SEQ ID NO: 1890 - RNA, 20 nt, Artificial Sequence
  Synthetic polynucleotide
auuacuucuuaccugggauu

SEQ ID NO: 1891 - RNA, 20 nt, Artificial Sequence
  Synthetic polynucleotide
ugcaauugccugguugggcc

SEQ ID NO: 1892 - RNA, 20 nt, Artificial Sequence
  Synthetic polynucleotide
cggagcuaaaagcaaauaua

SEQ ID NO: 1893 - RNA, 20 nt, Artificial Sequence
  Synthetic polynucleotide
cucggagcuaaaagcaaaua

SEQ ID NO: 1894 - RNA, 20 nt, Artificial Sequence
  Synthetic polynucleotide
caccuuuuugucugcauagu

SEQ ID NO: 1895 - RNA, 20 nt, Artificial Sequence
  Synthetic polynucleotide
aacucaccuuuuugucugca

SEQ ID NO: 1896 - RNA, 20 nt, Artificial Sequence
  Synthetic polynucleotide
agaggccuggauggaaacaa

SEQ ID NO: 1897 - RNA, 20 nt, Artificial Sequence
  Synthetic polynucleotide
aguaccuacaucaacaauua

SEQ ID NO: 1898 - RNA, 20 nt, Artificial Sequence
  Synthetic polynucleotide
auaaaaauauucuguugaag

SEQ ID NO: 1899 - RNA, 20 nt, Artificial Sequence
  Synthetic polynucleotide
ccuauaucaggguggggaga

SEQ ID NO: 1900 - RNA, 20 nt, Artificial Sequence
  Synthetic polynucleotide
ugucuaccuauaaaauuuac

SEQ ID NO: 1901 - RNA, 20 nt, Artificial Sequence
  Synthetic polynucleotide
uaaauaccuguagaauuaaa

SEQ ID NO: 1902 - RNA, 20 nt, Artificial Sequence
  Synthetic polynucleotide
acccacuuacucgacauuuu

SEQ ID NO: 1903 - RNA, 20 nt, Artificial Sequence
  Synthetic polynucleotide
gauuuuguucugcaaagaaa

SEQ ID NO: 1904 - RNA, 20 nt, Artificial Sequence
  Synthetic polynucleotide
uuacccucauuccuucaaau

SEQ ID NO: 1905 - RNA, 20 nt, Artificial Sequence
  Synthetic polynucleotide
uauauuuuuuuaccccuggu

SEQ ID NO: 1906 - RNA, 20 nt, Artificial Sequence
  Synthetic polynucleotide
uaguacacucauauccuuuu

SEQ ID NO: 1907 - RNA, 20 nt, Artificial Sequence
  Synthetic polynucleotide
acccucauuccuucaaaucu

SEQ ID NO: 1908 - RNA, 20 nt, Artificial Sequence
  Synthetic polynucleotide
aauauuacauacccugaauc

SEQ ID NO: 1909 - RNA, 20 nt, Artificial Sequence
  Synthetic polynucleotide
aaguaccuacaucaacaauu

SEQ ID NO: 1910 - RNA, 20 nt, Artificial Sequence
  Synthetic polynucleotide
caccuuuuugucugcauagu

SEQ ID NO: 1911 - RNA, 20 nt, Artificial Sequence
  Synthetic polynucleotide
uuacaacuugaagcagagau

SEQ ID NO: 1912 - DNA, 23 bp, Artificial Sequence
  Synthetic polynucleotide
gagcacgggcgaaagaccgaggg

SEQ ID NO: 1913 - DNA, 23 bp, Artificial Sequence
  Synthetic polynucleotide
gtattacgccacctggaaagaag

SEQ ID NO: 1914 - DNA, 23 bp, Artificial Sequence
  Synthetic polynucleotide
acagagtcaaaaccgcacaggag

SEQ ID NO: 1915 - DNA, 23 bp, Artificial Sequence
  Synthetic polynucleotide
ccacagagtcaaaaccgcacagg

SEQ ID NO: 1916 - DNA, 23 bp, Artificial Sequence
  Synthetic polynucleotide
agcttagcagatacaacctgtgg

SEQ ID NO: 1917 - DNA, 23 bp, Artificial Sequence
  Synthetic polynucleotide
cttagcagatacaacctgtgggg

SEQ ID NO: 1918 - DNA, 23 bp, Artificial Sequence
  Synthetic polynucleotide
tctgcccctatttctcagcgcag

SEQ ID NO: 1919 - DNA, 23 bp, Artificial Sequence
  Synthetic polynucleotide
tcatgaaaatttgcgacacaggg

SEQ ID NO: 1920 - DNA, 23 bp, Artificial Sequence
  Synthetic polynucleotide
ctacttttttccttgccacagag

SEQ ID NO: 1921 - DNA, 23 bp, Artificial Sequence
  Synthetic polynucleotide
gctgaaatggagtaataaggaag

SEQ ID NO: 1922 - DNA, 23 bp, Artificial Sequence
  Synthetic polynucleotide
atagagaatgaattgcaggggag

SEQ ID NO: 1923 - DNA, 23 bp, Artificial Sequence
  Synthetic polynucleotide
atgtgttttagccacgacctggg

SEQ ID NO: 1924 - DNA, 23 bp, Artificial Sequence
  Synthetic polynucleotide
aaacatcaatttagaccgtgtgg

SEQ ID NO: 1925 - DNA, 23 bp, Artificial Sequence
  Synthetic polynucleotide
aaaacattagccgggcacggtgg

SEQ ID NO: 1926 - DNA, 23 bp, Artificial Sequence
  Synthetic polynucleotide
agataatgggctgagcgcggtgg

SEQ ID NO: 1927 - DNA, 23 bp, Artificial Sequence
  Synthetic polynucleotide
ggcctactcagggatcaactggg

SEQ ID NO: 1928 - DNA, 23 bp, Artificial Sequence
  Synthetic polynucleotide
ggagtgcagtggtacgatgttgg

SEQ ID NO: 1929 - DNA, 23 bp, Artificial Sequence
  Synthetic polynucleotide
tggtcatgaggatttaaacggag

SEQ ID NO: 1930 - DNA, 23 bp, Artificial Sequence
  Synthetic polynucleotide
ccccacacagatatacctggtgg

SEQ ID NO: 1931 - DNA, 23 bp, Artificial Sequence
  Synthetic polynucleotide
tgcttggtagcgtaaccaccagg

SEQ ID NO: 1932 - DNA, 23 bp, Artificial Sequence
  Synthetic polynucleotide
acgcccgtaatccagcactttgg

SEQ ID NO: 1933 - DNA, 23 bp, Artificial Sequence
  Synthetic polynucleotide
gggattactaacctgcgtcgagg

SEQ ID NO: 1934 - DNA, 23 bp, Artificial Sequence
  Synthetic polynucleotide
ggattactaacctgcgtcgaggg

SEQ ID NO: 1935 - DNA, 23 bp, Artificial Sequence
  Synthetic polynucleotide
ttatcacgcagccctcgacgcag

SEQ ID NO: 1936 - DNA, 23 bp, Artificial Sequence
  Synthetic polynucleotide
ctagcaaaacagataccaaggag

SEQ ID NO: 1937 - DNA, 23 bp, Artificial Sequence
  Synthetic polynucleotide
ggagacaccgcatgttgtcaggg

SEQ ID NO: 1938 - DNA, 23 bp, Artificial Sequence
  Synthetic polynucleotide
gtgttttgagatccgtaaggcag

SEQ ID NO: 1939 - DNA, 23 bp, Artificial Sequence
  Synthetic polynucleotide
agcgtgttttgagatccgtaagg

SEQ ID NO: 1940 - DNA, 23 bp, Artificial Sequence
  Synthetic polynucleotide
ttacggatctcaaaacacgctag

SEQ ID NO: 1941 - DNA, 23 bp, Artificial Sequence
  Synthetic polynucleotide
ttctgatatatgctacgacccgg

SEQ ID NO: 1942 - DNA, 23 bp, Artificial Sequence
  Synthetic polynucleotide
tgaatcacagacctaaacgtcag

SEQ ID NO: 1943 - DNA, 23 bp, Artificial Sequence
  Synthetic polynucleotide
gcaaggatattctttcccatcag

SEQ ID NO: 1944 - DNA, 23 bp, Artificial Sequence
  Synthetic polynucleotide
taggggacttaacctccacaagg

SEQ ID NO: 1945 - DNA, 23 bp, Artificial Sequence
  Synthetic polynucleotide
tgggaaaaggtattgcctagggg

SEQ ID NO: 1946 - DNA, 23 bp, Artificial Sequence
  Synthetic polynucleotide
tggatacactgaacacaccgagg

SEQ ID NO: 1947 - DNA, 23 bp, Artificial Sequence
  Synthetic polynucleotide
agttcttatatagcaaaccggag

SEQ ID NO: 1948 - DNA, 23 bp, Artificial Sequence
  Synthetic polynucleotide
ataagaactgagctttagagaag

SEQ ID NO: 1949 - DNA, 23 bp, Artificial Sequence
  Synthetic polynucleotide
gctgtcttactattttactgcag

SEQ ID NO: 1950 - DNA, 23 bp, Artificial Sequence
  Synthetic polynucleotide
gtaataactttggcaccaggcag

SEQ ID NO: 1951 - DNA, 23 bp, Artificial Sequence
  Synthetic polynucleotide
ataaagtcttaactaacagagag

SEQ ID NO: 1952 - DNA, 23 bp, Artificial Sequence
  Synthetic polynucleotide
ggagaactgcttgaacccgggag

SEQ ID NO: 1953 - DNA, 23 bp, Artificial Sequence
  Synthetic polynucleotide
tagttatcattgggacacctggg

SEQ ID NO: 1954 - DNA, 23 bp, Artificial Sequence
  Synthetic polynucleotide
agtgagctgagatcgcaccaagg

SEQ ID NO: 1955 - DNA, 23 bp, Artificial Sequence
  Synthetic polynucleotide
attgggtctccaataccaaacag

SEQ ID NO: 1956 - DNA, 23 bp, Artificial Sequence
  Synthetic polynucleotide
ggccctgtaggcgttacactagg

SEQ ID NO: 1957 - DNA, 23 bp, Artificial Sequence
  Synthetic polynucleotide
ggtgggaacaacacacactgggg

SEQ ID NO: 1958 - DNA, 23 bp, Artificial Sequence
  Synthetic polynucleotide
ccacatggatggatacacaaggg

SEQ ID NO: 1959 - DNA, 23 bp, Artificial Sequence
  Synthetic polynucleotide
agtcagctatgattgcaccacag

SEQ ID NO: 1960 - DNA, 23 bp, Artificial Sequence
  Synthetic polynucleotide
gcttgtacgcaaataacagggag

SEQ ID NO: 1961 - DNA, 23 bp, Artificial Sequence
  Synthetic polynucleotide
agccctaaacccgtaaaatgggg

SEQ ID NO: 1962 - DNA, 23 bp, Artificial Sequence
  Synthetic polynucleotide
gctcagctgaaccagagcaagag

SEQ ID NO: 1963 - DNA, 23 bp, Artificial Sequence
  Synthetic polynucleotide
aatctgatttggcgacacaaagg

SEQ ID NO: 1964 - DNA, 23 bp, Artificial Sequence
  Synthetic polynucleotide
ttgcccactggtgatcaccaggg

SEQ ID NO: 1965 - DNA, 23 bp, Artificial Sequence
  Synthetic polynucleotide
gtatgcataggggtatactttag

SEQ ID NO: 1966 - DNA, 23 bp, Artificial Sequence
  Synthetic polynucleotide
tatagacaagtccacgaaccagg

SEQ ID NO: 1967 - DNA, 23 bp, Artificial Sequence
  Synthetic polynucleotide
tagacaagtccacgaaccaggag

SEQ ID NO: 1968 - DNA, 23 bp, Artificial Sequence
  Synthetic polynucleotide
atacctcagaccgggcatggtgg

SEQ ID NO: 1969 - DNA, 23 bp, Artificial Sequence
  Synthetic polynucleotide
aatgaagtggaagtacacagtag

SEQ ID NO: 1970 - DNA, 23 bp, Artificial Sequence
  Synthetic polynucleotide
ataagatggtcacagcttggggg

SEQ ID NO: 1971 - DNA, 23 bp, Artificial Sequence
  Synthetic polynucleotide
tcctgcctcagccttccgaggag

SEQ ID NO: 1972 - DNA, 23 bp, Artificial Sequence
  Synthetic polynucleotide
gcttatgggattaacccacaagg

SEQ ID NO: 1973 - DNA, 23 bp, Artificial Sequence
  Synthetic polynucleotide
ggagccacagattgttagcagag

SEQ ID NO: 1974 - DNA, 23 bp, Artificial Sequence
  Synthetic polynucleotide
acacggaaaacaaatccaggaag

SEQ ID NO: 1975 - DNA, 23 bp, Artificial Sequence
  Synthetic polynucleotide
tgggagatcaacatgcctagtgg

SEQ ID NO: 1976 - DNA, 23 bp, Artificial Sequence
  Synthetic polynucleotide
gcacctgctccatatttagtaag

SEQ ID NO: 1977 - DNA, 23 bp, Artificial Sequence
  Synthetic polynucleotide
cttgagccgtcaaagacacacag

SEQ ID NO: 1978 - DNA, 23 bp, Artificial Sequence
  Synthetic polynucleotide
gtattaccacttcgtgaaaagag

SEQ ID NO: 1979 - DNA, 23 bp, Artificial Sequence
  Synthetic polynucleotide
gcttgtttactcttttcacgaag

SEQ ID NO: 1980 - DNA, 23 bp, Artificial Sequence
  Synthetic polynucleotide
ccatctttgttgtttcaaggcag

SEQ ID NO: 1981 - DNA, 23 bp, Artificial Sequence
  Synthetic polynucleotide
gaatactcccaaattcagggagg

SEQ ID NO: 1982 - DNA, 23 bp, Artificial Sequence
  Synthetic polynucleotide
agagcatactgacctcaacgtgg

SEQ ID NO: 1983 - DNA, 23 bp, Artificial Sequence
  Synthetic polynucleotide
tagatacccatcttatacacagg

SEQ ID NO: 1984 - DNA, 23 bp, Artificial Sequence
  Synthetic polynucleotide
acactgctgcttcacatcagggg

SEQ ID NO: 1985 - DNA, 23 bp, Artificial Sequence
  Synthetic polynucleotide
gataccattaactatcacctggg

SEQ ID NO: 1986 - DNA, 23 bp, Artificial Sequence
  Synthetic polynucleotide
gagactctattctaaacgtgagg

SEQ ID NO: 1987 - DNA, 23 bp, Artificial Sequence
  Synthetic polynucleotide
taactgcagtagttgaccattgg

SEQ ID NO: 1988 - DNA, 23 bp, Artificial Sequence
  Synthetic polynucleotide
tttgctatgacacagtacagaag

SEQ ID NO: 1989 - DNA, 23 bp, Artificial Sequence
  Synthetic polynucleotide
tcttagacggtataaagtgggag

SEQ ID NO: 1990 - DNA, 23 bp, Artificial Sequence
  Synthetic polynucleotide
gagggtcacttgaatcccagagg

SEQ ID NO: 1991 - DNA, 23 bp, Artificial Sequence
  Synthetic polynucleotide
ttttaaatttgatttccgaagag

SEQ ID NO: 1992 - DNA, 23 bp, Artificial Sequence
  Synthetic polynucleotide
ttcgtgacctgacaattgggcag

SEQ ID NO: 1993 - DNA, 23 bp, Artificial Sequence
  Synthetic polynucleotide
aagccctaaatcaatgccgaggg

SEQ ID NO: 1994 - DNA, 23 bp, Artificial Sequence
  Synthetic polynucleotide
gggcatgtccctttcatacagag

SEQ ID NO: 1995 - DNA, 23 bp, Artificial Sequence
  Synthetic polynucleotide
gcactcttcccaggatacaagag

SEQ ID NO: 1996 - DNA, 23 bp, Artificial Sequence
  Synthetic polynucleotide
ggaatattcctagtcccaagagg

SEQ ID NO: 1997 - DNA, 23 bp, Artificial Sequence
  Synthetic polynucleotide
cctctcataagaaatcactggag

SEQ ID NO: 1998 - DNA, 23 bp, Artificial Sequence
  Synthetic polynucleotide
tacactgtaaacggcctgagagg

SEQ ID NO: 1999 - DNA, 23 bp, Artificial Sequence
  Synthetic polynucleotide
ttacactgtaaacggcctgagag

SEQ ID NO: 2000 - DNA, 23 bp, Artificial Sequence
  Synthetic polynucleotide
ccccaaaatcgattaagctgagg

SEQ ID NO: 2001 - DNA, 23 bp, Artificial Sequence
  Synthetic polynucleotide
cctccctcatgggaacatggagg

SEQ ID NO: 2002 - DNA, 23 bp, Artificial Sequence
  Synthetic polynucleotide
gcacagtctgagcatgtacagag

SEQ ID NO: 2003 - DNA, 23 bp, Artificial Sequence
  Synthetic polynucleotide
ggtgctagagaacagccaatcag

SEQ ID NO: 2004 - DNA, 23 bp, Artificial Sequence
  Synthetic polynucleotide
cgtcatgtagaatatggcagaag

SEQ ID NO: 2005 - DNA, 23 bp, Artificial Sequence
  Synthetic polynucleotide
aagacatgttacattgtaggggg

SEQ ID NO: 2006 - DNA, 23 bp, Artificial Sequence
  Synthetic polynucleotide
agtcaactctgcaaaacaaggag

SEQ ID NO: 2007 - DNA, 23 bp, Artificial Sequence
  Synthetic polynucleotide
ttaatgaaagccaatcatcgagg

SEQ ID NO: 2008 - DNA, 23 bp, Artificial Sequence
  Synthetic polynucleotide
actctggtaactccacctggagg

SEQ ID NO: 2009 - DNA, 23 bp, Artificial Sequence
  Synthetic polynucleotide
agctatagtagaatcctgtgtgg

SEQ ID NO: 2010 - DNA, 23 bp, Artificial Sequence
  Synthetic polynucleotide
tgtacatagacccagcacaaggg

SEQ ID NO: 2011 - DNA, 23 bp, Artificial Sequence
  Synthetic polynucleotide
ttaggaaccaggctgcacagcag

SEQ ID NO: 2012 - DNA, 23 bp, Artificial Sequence
  Synthetic polynucleotide
tattgtgaactgcacatacgagg

SEQ ID NO: 2013 - DNA, 23 bp, Artificial Sequence
  Synthetic polynucleotide
attgtgaactgcacatacgaggg

SEQ ID NO: 2014 - DNA, 23 bp, Artificial Sequence
  Synthetic polynucleotide
gataacacctggcaatccagcag

SEQ ID NO: 2015 - DNA, 23 bp, Artificial Sequence
  Synthetic polynucleotide
gctctcttagtgataacacctgg

SEQ ID NO: 2016 - DNA, 23 bp, Artificial Sequence
  Synthetic polynucleotide
aaactgttaacacaagagggagg

SEQ ID NO: 2017 - DNA, 23 bp, Artificial Sequence
  Synthetic polynucleotide
caacagactgtaagccctagagg

SEQ ID NO: 2018 - DNA, 23 bp, Artificial Sequence
  Synthetic polynucleotide
gggacacaatactaactaggtgg

SEQ ID NO: 2019 - DNA, 23 bp, Artificial Sequence
  Synthetic polynucleotide
gattttaaggtttacccccgcag

SEQ ID NO: 2020 - DNA, 23 bp, Artificial Sequence
  Synthetic polynucleotide
tgacactctggaacattagagag

SEQ ID NO: 2021 - DNA, 23 bp, Artificial Sequence
  Synthetic polynucleotide
tcactctctctaatgttccagag

SEQ ID NO: 2022 - DNA, 23 bp, Artificial Sequence
  Synthetic polynucleotide
ttaagagtatgaaatcctacaag

SEQ ID NO: 2023 - DNA, 23 bp, Artificial Sequence
  Synthetic polynucleotide
ggaggtcgcttgagtgcacgagg

SEQ ID NO: 2024 - DNA, 23 bp, Artificial Sequence
  Synthetic polynucleotide
atattgcgtttataccacagaag

SEQ ID NO: 2025 - DNA, 23 bp, Artificial Sequence
  Synthetic polynucleotide
ttaccattgagagatccttggag

SEQ ID NO: 2026 - DNA, 23 bp, Artificial Sequence
  Synthetic polynucleotide
aaggtgatgttatcgaacatagg

SEQ ID NO: 2027 - DNA, 23 bp, Artificial Sequence
  Synthetic polynucleotide
tgatgttatcgaacataggagag

SEQ ID NO: 2028 - DNA, 23 bp, Artificial Sequence
  Synthetic polynucleotide
gacaaggatacgcttaaccctgg

SEQ ID NO: 2029 - DNA, 23 bp, Artificial Sequence
  Synthetic polynucleotide
ttaagcgtatccttgtcagccag

SEQ ID NO: 2030 - DNA, 23 bp, Artificial Sequence
  Synthetic polynucleotide
gatccattagaaatgctgatcag

SEQ ID NO: 2031 - DNA, 23 bp, Artificial Sequence
  Synthetic polynucleotide
gcactccagcctgaaccagagag

SEQ ID NO: 2032 - DNA, 23 bp, Artificial Sequence
  Synthetic polynucleotide
ggagaattacttgaacccagcag

SEQ ID NO: 2033 - DNA, 23 bp, Artificial Sequence
  Synthetic polynucleotide
gttaataatcatgctccgaagag

SEQ ID NO: 2034 - DNA, 23 bp, Artificial Sequence
  Synthetic polynucleotide
gagttaataatcatgctccgaag

SEQ ID NO: 2035 - DNA, 23 bp, Artificial Sequence
  Synthetic polynucleotide
gaggttatgtcatctccacaggg

SEQ ID NO: 2036 - DNA, 23 bp, Artificial Sequence
  Synthetic polynucleotide
tcttgcttattgcttgacaacag

SEQ ID NO: 2037 - DNA, 23 bp, Artificial Sequence
  Synthetic polynucleotide
gagccatgatcacaccactgcgg

SEQ ID NO: 2038 - DNA, 23 bp, Artificial Sequence
  Synthetic polynucleotide
aaggcgggtgaatcacttgaggg

SEQ ID NO: 2039 - DNA, 23 bp, Artificial Sequence
  Synthetic polynucleotide
caaggcgggtgaatcacttgagg

SEQ ID NO: 2040 - DNA, 23 bp, Artificial Sequence
  Synthetic polynucleotide
accctggtcaatagccacagtgg

SEQ ID NO: 2041 - DNA, 23 bp, Artificial Sequence
  Synthetic polynucleotide
aatgcaggtatactccactgtgg

SEQ ID NO: 2042 - DNA, 23 bp, Artificial Sequence
  Synthetic polynucleotide
atacactcttgacaaccatagag

SEQ ID NO: 2043 - DNA, 23 bp, Artificial Sequence
  Synthetic polynucleotide
ccccattctcaaattccaagcag

SEQ ID NO: 2044 - DNA, 23 bp, Artificial Sequence
  Synthetic polynucleotide
gatgtgttcttcaagtagcagag

SEQ ID NO: 2045 - DNA, 23 bp, Artificial Sequence
  Synthetic polynucleotide
gagactaatgtcgaacaacatgg

SEQ ID NO: 2046 - DNA, 23 bp, Artificial Sequence
  Synthetic polynucleotide
ttttagctagaaccagggtggag

SEQ ID NO: 2047 - DNA, 23 bp, Artificial Sequence
  Synthetic polynucleotide
ctgactaatgaaaactcctgtgg

SEQ ID NO: 2048 - DNA, 23 bp, Artificial Sequence
  Synthetic polynucleotide
taggctgacagggttacagaggg

SEQ ID NO: 2049 - DNA, 23 bp, Artificial Sequence
  Synthetic polynucleotide
atgctagtggtaccatgcatggg

SEQ ID NO: 2050 - DNA, 23 bp, Artificial Sequence
  Synthetic polynucleotide
gcctcactagactttcagtgtag

SEQ ID NO: 2051 - DNA, 23 bp, Artificial Sequence
  Synthetic polynucleotide
gcaccccaaaacaattaccacag

SEQ ID NO: 2052 - DNA, 23 bp, Artificial Sequence
  Synthetic polynucleotide
ttaagccaaagcctaatccacag

SEQ ID NO: 2053 - DNA, 23 bp, Artificial Sequence
  Synthetic polynucleotide
gctgcattatcccctaacaagag

SEQ ID NO: 2054 - DNA, 23 bp, Artificial Sequence
  Synthetic polynucleotide
ctatttatagagcacaggcagag

SEQ ID NO: 2055 - DNA, 23 bp, Artificial Sequence
  Synthetic polynucleotide
tgagctataagtatcaacactgg

SEQ ID NO: 2056 - DNA, 23 bp, Artificial Sequence
  Synthetic polynucleotide
ccaggcacattgtcaataggcag

SEQ ID NO: 2057 - DNA, 23 bp, Artificial Sequence
  Synthetic polynucleotide
gtcactcaagagctctaacggag

SEQ ID NO: 2058 - DNA, 23 bp, Artificial Sequence
  Synthetic polynucleotide
actcaagagctctaacggagagg

SEQ ID NO: 2059 - DNA, 23 bp, Artificial Sequence
  Synthetic polynucleotide
tctgtagcctatgggccaaagag

SEQ ID NO: 2060 - DNA, 23 bp, Artificial Sequence
  Synthetic polynucleotide
ttaggattgacttggcgatgcgg

SEQ ID NO: 2061 - DNA, 23 bp, Artificial Sequence
  Synthetic polynucleotide
gtttgtagttctcctcgaagagg

SEQ ID NO: 2062 - DNA, 23 bp, Artificial Sequence
  Synthetic polynucleotide
agggagactttataaaccggagg

SEQ ID NO: 2063 - DNA, 23 bp, Artificial Sequence
  Synthetic polynucleotide
agtgagccaaaatcgcgccacgg

SEQ ID NO: 2064 - DNA, 23 bp, Artificial Sequence
  Synthetic polynucleotide
aggtgggcagaacacaacgtcag

SEQ ID NO: 2065 - DNA, 23 bp, Artificial Sequence
  Synthetic polynucleotide
aaacttacaatcatggtcgaagg

SEQ ID NO: 2066 - DNA, 23 bp, Artificial Sequence
  Synthetic polynucleotide
ggctttttatttgtatgcggcag

SEQ ID NO: 2067 - DNA, 23 bp, Artificial Sequence
  Synthetic polynucleotide
catttctcaccgtattcaggagg

SEQ ID NO: 2068 - DNA, 23 bp, Artificial Sequence
  Synthetic polynucleotide
gcatttctcaccgtattcaggag

SEQ ID NO: 2069 - DNA, 23 bp, Artificial Sequence
  Synthetic polynucleotide
acttacctcctgaatacggtgag

SEQ ID NO: 2070 - DNA, 23 bp, Artificial Sequence
  Synthetic polynucleotide
gattcctcacttactaaccacgg

SEQ ID NO: 2071 - DNA, 23 bp, Artificial Sequence
  Synthetic polynucleotide
attaccgtggttagtaagtgagg

SEQ ID NO: 2072 - DNA, 23 bp, Artificial Sequence
  Synthetic polynucleotide
cctaagttgaaggaacgtcagag

SEQ ID NO: 2073 - DNA, 23 bp, Artificial Sequence
  Synthetic polynucleotide
cgcatctatcaatgtcaccttgg

SEQ ID NO: 2074 - DNA, 23 bp, Artificial Sequence
  Synthetic polynucleotide
ggaacaaaagagacgacagtggg

SEQ ID NO: 2075 - DNA, 23 bp, Artificial Sequence
  Synthetic polynucleotide
tatgaccatgaataacccaccgg

SEQ ID NO: 2076 - DNA, 23 bp, Artificial Sequence
  Synthetic polynucleotide
catttttggtccagtccggtggg

SEQ ID NO: 2077 - DNA, 23 bp, Artificial Sequence
  Synthetic polynucleotide
agggtgtgtccataacccaacag

SEQ ID NO: 2078 - DNA, 23 bp, Artificial Sequence
  Synthetic polynucleotide
gtaaaagtgtacctaaacacaag

SEQ ID NO: 2079 - DNA, 23 bp, Artificial Sequence
  Synthetic polynucleotide
tcacttttcttcgtgacccgtgg

SEQ ID NO: 2080 - DNA, 23 bp, Artificial Sequence
  Synthetic polynucleotide
ttaatcttaggcttagtaagcag

SEQ ID NO: 2081 - DNA, 23 bp, Artificial Sequence
  Synthetic polynucleotide
gagccacctagacaatacagaag

SEQ ID NO: 2082 - DNA, 23 bp, Artificial Sequence
  Synthetic polynucleotide
gccacctagacaatacagaaggg

SEQ ID NO: 2083 - DNA, 23 bp, Artificial Sequence
  Synthetic polynucleotide
tcaccactacctaattagagaag

SEQ ID NO: 2084 - DNA, 23 bp, Artificial Sequence
  Synthetic polynucleotide
gagagtggggttaaacaccaggg

SEQ ID NO: 2085 - DNA, 23 bp, Artificial Sequence
  Synthetic polynucleotide
tgtaggggctttgatccagtcag

SEQ ID NO: 2086 - DNA, 23 bp, Artificial Sequence
  Synthetic polynucleotide
ctgctagatagcttagaaccagg

SEQ ID NO: 2087 - DNA, 23 bp, Artificial Sequence
  Synthetic polynucleotide
cctggttctaagctatctagcag

SEQ ID NO: 2088 - DNA, 23 bp, Artificial Sequence
  Synthetic polynucleotide
tcatctgtatgcactctcagaag

SEQ ID NO: 2089 - DNA, 23 bp, Artificial Sequence
  Synthetic polynucleotide
gctgtctcagccaatcacagcag

SEQ ID NO: 2090 - DNA, 23 bp, Artificial Sequence
  Synthetic polynucleotide
gcttaaatgccatcacctcagag

SEQ ID NO: 2091 - DNA, 23 bp, Artificial Sequence
  Synthetic polynucleotide
tctttcctcctgtttcggtggag

SEQ ID NO: 2092 - DNA, 23 bp, Artificial Sequence
  Synthetic polynucleotide
gccagattatgtgtagactgtgg

SEQ ID NO: 2093 - DNA, 23 bp, Artificial Sequence
  Synthetic polynucleotide
gttttagcccaatataaccacag

SEQ ID NO: 2094 - DNA, 23 bp, Artificial Sequence
  Synthetic polynucleotide
gcacatgatactctacactctgg

SEQ ID NO: 2095 - DNA, 23 bp, Artificial Sequence
  Synthetic polynucleotide
gaagagtatatccccaacgaagg

SEQ ID NO: 2096 - DNA, 23 bp, Artificial Sequence
  Synthetic polynucleotide
ggaatgcagcataacggcaaagg

SEQ ID NO: 2097 - DNA, 23 bp, Artificial Sequence
  Synthetic polynucleotide
ccatgtatattaaatctacagag

SEQ ID NO: 2098 - DNA, 23 bp, Artificial Sequence
  Synthetic polynucleotide
aacactcctgaacctcgggaagg

SEQ ID NO: 2099 - DNA, 23 bp, Artificial Sequence
  Synthetic polynucleotide
tactgagtctgcctcttccggag

SEQ ID NO: 2100 - DNA, 23 bp, Artificial Sequence
  Synthetic polynucleotide
tatgtggtacaatactccggaag

SEQ ID NO: 2101 - DNA, 23 bp, Artificial Sequence
  Synthetic polynucleotide
taggctataccacatagcctagg

SEQ ID NO: 2102 - DNA, 23 bp, Artificial Sequence
  Synthetic polynucleotide
gtataggctaccatacacctagg

SEQ ID NO: 2103 - DNA, 23 bp, Artificial Sequence
  Synthetic polynucleotide
ggtttgtataagtgcaccctagg

SEQ ID NO: 2104 - DNA, 23 bp, Artificial Sequence
  Synthetic polynucleotide
gaaaataaattaaggcaacgtgg

SEQ ID NO: 2105 - DNA, 23 bp, Artificial Sequence
  Synthetic polynucleotide
gtgctcgaattaacacaagacag

SEQ ID NO: 2106 - DNA, 23 bp, Artificial Sequence
  Synthetic polynucleotide
tcttctttctggaaaacgaagag

SEQ ID NO: 2107 - DNA, 23 bp, Artificial Sequence
  Synthetic polynucleotide
cgtgtgtagtcagtgtccagagg

SEQ ID NO: 2108 - DNA, 23 bp, Artificial Sequence
  Synthetic polynucleotide
tgatatactcaggaaggcgagag

SEQ ID NO: 2109 - DNA, 23 bp, Artificial Sequence
  Synthetic polynucleotide
gtacttaactaggaccccatggg

SEQ ID NO: 2110 - DNA, 23 bp, Artificial Sequence
  Synthetic polynucleotide
ccaaaccatgaaaaccctagaag

SEQ ID NO: 2111 - DNA, 23 bp, Artificial Sequence
  Synthetic polynucleotide
gcatggtagtggtacccaaacag

SEQ ID NO: 2112 - DNA, 23 bp, Artificial Sequence
  Synthetic polynucleotide
gacaactacctaatgcatgcagg

SEQ ID NO: 2113 - DNA, 23 bp, Artificial Sequence
  Synthetic polynucleotide
ataggtggagcaaaccaccatag

SEQ ID NO: 2114 - DNA, 23 bp, Artificial Sequence
  Synthetic polynucleotide
ggtgggcaatgagaacacatggg

SEQ ID NO: 2115 - DNA, 23 bp, Artificial Sequence
  Synthetic polynucleotide
gagaagatcatcacacactgggg

SEQ ID NO: 2116 - DNA, 23 bp, Artificial Sequence
  Synthetic polynucleotide
atgggtgcagcaaaccaccatgg

SEQ ID NO: 2117 - DNA, 23 bp, Artificial Sequence
  Synthetic polynucleotide
acatgggtagacacgtgccatgg

SEQ ID NO: 2118 - DNA, 23 bp, Artificial Sequence
  Synthetic polynucleotide
tacgacaaagaagatcatgtagg

SEQ ID NO: 2119 - DNA, 23 bp, Artificial Sequence
  Synthetic polynucleotide
cggttacaacagaggctctgcgg

SEQ ID NO: 2120 - DNA, 23 bp, Artificial Sequence
  Synthetic polynucleotide
agaaggccaagcatataccgcag

SEQ ID NO: 2121 - DNA, 23 bp, Artificial Sequence
  Synthetic polynucleotide
acacacaatggatttccccagag

SEQ ID NO: 2122 - DNA, 23 bp, Artificial Sequence
  Synthetic polynucleotide
actgttttagtcataccccatag

SEQ ID NO: 2123 - DNA, 23 bp, Artificial Sequence
  Synthetic polynucleotide
ggagtctaatgtattaggggagg

SEQ ID NO: 2124 - DNA, 23 bp, Artificial Sequence
  Synthetic polynucleotide
actacctagggaattcccagaag

SEQ ID NO: 2125 - DNA, 23 bp, Artificial Sequence
  Synthetic polynucleotide
tatgcccttcgacaccaaggtgg

SEQ ID NO: 2126 - DNA, 23 bp, Artificial Sequence
  Synthetic polynucleotide
gtttccaccttggtgtcgaaggg

SEQ ID NO: 2127 - DNA, 23 bp, Artificial Sequence
  Synthetic polynucleotide
tgctaaatgtgtatcacccgagg

SEQ ID NO: 2128 - DNA, 23 bp, Artificial Sequence
  Synthetic polynucleotide
tttagggtaagagaactcgggag

SEQ ID NO: 2129 - DNA, 23 bp, Artificial Sequence
  Synthetic polynucleotide
ttataagcagggaggcctgagag

SEQ ID NO: 2130 - DNA, 23 bp, Artificial Sequence
  Synthetic polynucleotide
gaagttgcccaataccaaagagg

SEQ ID NO: 2131 - DNA, 23 bp, Artificial Sequence
  Synthetic polynucleotide
agaagttgcccaataccaaagag

SEQ ID NO: 2132 - DNA, 23 bp, Artificial Sequence
  Synthetic polynucleotide
ttttctgcaaggcgaagcagcag

SEQ ID NO: 2133 - DNA, 23 bp, Artificial Sequence
  Synthetic polynucleotide
tgctgtggactgcaacggtgtgg

SEQ ID NO: 2134 - DNA, 23 bp, Artificial Sequence
  Synthetic polynucleotide
ctgagcgtccatcaaccagggag

SEQ ID NO: 2135 - DNA, 23 bp, Artificial Sequence
  Synthetic polynucleotide
gtagctcctaagttgaaacggag

SEQ ID NO: 2136 - DNA, 23 bp, Artificial Sequence
  Synthetic polynucleotide
tagctcctaagttgaaacggagg

SEQ ID NO: 2137 - DNA, 23 bp, Artificial Sequence
  Synthetic polynucleotide
aaggtctacgagtcactaagtgg

SEQ ID NO: 2138 - DNA, 23 bp, Artificial Sequence
  Synthetic polynucleotide
gtaagagacaaccattacaggag

SEQ ID NO: 2139 - DNA, 23 bp, Artificial Sequence
  Synthetic polynucleotide
actggctgtatatcataggagag

SEQ ID NO: 2140 - DNA, 23 bp, Artificial Sequence
  Synthetic polynucleotide
gctctcctatgatatacagccag

SEQ ID NO: 2141 - DNA, 23 bp, Artificial Sequence
  Synthetic polynucleotide
gcacgaccaatcaaatacacaag

SEQ ID NO: 2142 - DNA, 23 bp, Artificial Sequence
  Synthetic polynucleotide
tgtcatgggactaaaaacacagg

SEQ ID NO: 2143 - DNA, 23 bp, Artificial Sequence
  Synthetic polynucleotide
gcaaatctgtaccaccaaggtgg

SEQ ID NO: 2144 - DNA, 23 bp, Artificial Sequence
  Synthetic polynucleotide
tgtgcaaatctgtaccaccaagg

SEQ ID NO: 2145 - DNA, 23 bp, Artificial Sequence
  Synthetic polynucleotide
ggaacaccacccaatgactgagg

SEQ ID NO: 2146 - DNA, 23 bp, Artificial Sequence
  Synthetic polynucleotide
ataaaaggttaccatcttgggag

SEQ ID NO: 2147 - DNA, 23 bp, Artificial Sequence
  Synthetic polynucleotide
ctatatgccaggctaataagcag

SEQ ID NO: 2148 - DNA, 23 bp, Artificial Sequence
  Synthetic polynucleotide
tgctaactcagcgagcacatggg

SEQ ID NO: 2149 - DNA, 23 bp, Artificial Sequence
  Synthetic polynucleotide
agttctgcgatcattcagactgg

SEQ ID NO: 2150 - DNA, 23 bp, Artificial Sequence
  Synthetic polynucleotide
ggttacctagagcccctactgag

SEQ ID NO: 2151 - DNA, 23 bp, Artificial Sequence
  Synthetic polynucleotide
tgatggccaacactaaggtgagg

SEQ ID NO: 2152 - DNA, 23 bp, Artificial Sequence
  Synthetic polynucleotide
ttactagtatagcttcaagagag

SEQ ID NO: 2153 - DNA, 23 bp, Artificial Sequence
  Synthetic polynucleotide
atagaggctagtcttacacatgg

SEQ ID NO: 2154 - DNA, 23 bp, Artificial Sequence
  Synthetic polynucleotide
taagactagcctctatagcaagg

SEQ ID NO: 2155 - DNA, 23 bp, Artificial Sequence
  Synthetic polynucleotide
cacgcgatgctataggccagtgg

SEQ ID NO: 2156 - DNA, 23 bp, Artificial Sequence
  Synthetic polynucleotide
cactggcctatagcatcgcgtgg

SEQ ID NO: 2157 - DNA, 23 bp, Artificial Sequence
  Synthetic polynucleotide
actgtgacaagtcaacgtggcag

SEQ ID NO: 2158 - DNA, 23 bp, Artificial Sequence
  Synthetic polynucleotide
ccaactgtgacaagtcaacgtgg

SEQ ID NO: 2159 - DNA, 23 bp, Artificial Sequence
  Synthetic polynucleotide
gtagttcctccattagtcaagag

SEQ ID NO: 2160 - DNA, 23 bp, Artificial Sequence
  Synthetic polynucleotide
tctatatcaggaaacttgcgaag

SEQ ID NO: 2161 - DNA, 23 bp, Artificial Sequence
  Synthetic polynucleotide
acacggataagaccacatgagag

SEQ ID NO: 2162 - DNA, 23 bp, Artificial Sequence
  Synthetic polynucleotide
ttaccagatgaatcttcaggaag

SEQ ID NO: 2163 - DNA, 23 bp, Artificial Sequence
  Synthetic polynucleotide
tgatgtatccatgatccgcaaag

SEQ ID NO: 2164 - DNA, 23 bp, Artificial Sequence
  Synthetic polynucleotide
tactcgcccatagatatcgaggg

SEQ ID NO: 2165 - DNA, 23 bp, Artificial Sequence
  Synthetic polynucleotide
ctactcgcccatagatatcgagg

SEQ ID NO: 2166 - DNA, 23 bp, Artificial Sequence
  Synthetic polynucleotide
ctcaactggaaatcgtcccaggg

SEQ ID NO: 2167 - DNA, 23 bp, Artificial Sequence
  Synthetic polynucleotide
agctaacatgatactaaccaggg

SEQ ID NO: 2168 - DNA, 23 bp, Artificial Sequence
  Synthetic polynucleotide
ataaagctatagtaaccaaacag

SEQ ID NO: 2169 - DNA, 23 bp, Artificial Sequence
  Synthetic polynucleotide
ctcaacatcactaatcaccaggg

SEQ ID NO: 2170 - DNA, 23 bp, Artificial Sequence
  Synthetic polynucleotide
ggcaacatgaatgaacctggagg

SEQ ID NO: 2171 - DNA, 23 bp, Artificial Sequence
  Synthetic polynucleotide
ctacttctatgacaaccctttag

SEQ ID NO: 2172 - DNA, 23 bp, Artificial Sequence
  Synthetic polynucleotide
agtagaatagtggttatcggagg

SEQ ID NO: 2173 - DNA, 23 bp, Artificial Sequence
  Synthetic polynucleotide
ctagtcatccaacgattcaatag

SEQ ID NO: 2174 - DNA, 23 bp, Artificial Sequence
  Synthetic polynucleotide
tctctggcccggtactcacgtag

SEQ ID NO: 2175 - DNA, 23 bp, Artificial Sequence
  Synthetic polynucleotide
acacagggagaaaactacgtgag

SEQ ID NO: 2176 - DNA, 23 bp, Artificial Sequence
  Synthetic polynucleotide
gtccaaatccaatataactgggg

SEQ ID NO: 2177 - DNA, 23 bp, Artificial Sequence
  Synthetic polynucleotide
tgccacgataaggcccaaagagg

SEQ ID NO: 2178 - DNA, 23 bp, Artificial Sequence
  Synthetic polynucleotide
aatttcatcaacaagccagggag

SEQ ID NO: 2179 - DNA, 23 bp, Artificial Sequence
  Synthetic polynucleotide
ccacagatcagcagtccacgtgg

SEQ ID NO: 2180 - DNA, 23 bp, Artificial Sequence
  Synthetic polynucleotide
gtagagaaagaaatagaacgaag

SEQ ID NO: 2181 - DNA, 23 bp, Artificial Sequence
  Synthetic polynucleotide
ggaagggcaaaactttcccagag

SEQ ID NO: 2182 - DNA, 23 bp, Artificial Sequence
  Synthetic polynucleotide
aagattgtagagacctcaagggg

SEQ ID NO: 2183 - DNA, 23 bp, Artificial Sequence
  Synthetic polynucleotide
acagatggtgatgaccaatgggg

SEQ ID NO: 2184 - DNA, 23 bp, Artificial Sequence
  Synthetic polynucleotide
ggggccgtgcaaatatatggagg

SEQ ID NO: 2185 - DNA, 23 bp, Artificial Sequence
  Synthetic polynucleotide
gggccgtgcaaatatatggaggg

SEQ ID NO: 2186 - DNA, 23 bp, Artificial Sequence
  Synthetic polynucleotide
cctcaagtgatcgcccacctcgg

SEQ ID NO: 2187 - DNA, 23 bp, Artificial Sequence
  Synthetic polynucleotide
gggagcttagactagtatggtag

SEQ ID NO: 2188 - DNA, 23 bp, Artificial Sequence
  Synthetic polynucleotide
agagttgcacagtagcccaatag

SEQ ID NO: 2189 - DNA, 23 bp, Artificial Sequence
  Synthetic polynucleotide
tctggattattctctctggacag

SEQ ID NO: 2190 - DNA, 23 bp, Artificial Sequence
  Synthetic polynucleotide
agagatgcacaatagcccgacag

SEQ ID NO: 2191 - DNA, 23 bp, Artificial Sequence
  Synthetic polynucleotide
ctattccgtttgaatagcagaag

SEQ ID NO: 2192 - DNA, 23 bp, Artificial Sequence
  Synthetic polynucleotide
aggatcccaggactaccaggtgg

SEQ ID NO: 2193 - DNA, 23 bp, Artificial Sequence
  Synthetic polynucleotide
gatgtctccacggtacatggagg

SEQ ID NO: 2194 - DNA, 23 bp, Artificial Sequence
  Synthetic polynucleotide
aacttatcctccatgtaccgtgg

SEQ ID NO: 2195 - DNA, 23 bp, Artificial Sequence
  Synthetic polynucleotide
cttatcctccatgtaccgtggag

SEQ ID NO: 2196 - DNA, 23 bp, Artificial Sequence
  Synthetic polynucleotide
agtttgggtggaattccaggcag

SEQ ID NO: 2197 - DNA, 23 bp, Artificial Sequence
  Synthetic polynucleotide
actaaagtgacagatagtcaggg

SEQ ID NO: 2198 - DNA, 23 bp, Artificial Sequence
  Synthetic polynucleotide
tcactgcaaacacaaccctgagg

SEQ ID NO: 2199 - DNA, 23 bp, Artificial Sequence
  Synthetic polynucleotide
taggtaaacacgtgtcatggggg

SEQ ID NO: 2200 - DNA, 23 bp, Artificial Sequence
  Synthetic polynucleotide
ataggtaaacacgtgtcatgggg

SEQ ID NO: 2201 - DNA, 23 bp, Artificial Sequence
  Synthetic polynucleotide
gtttacatattattttaacgaag

SEQ ID NO: 2202 - DNA, 23 bp, Artificial Sequence
  Synthetic polynucleotide
ggtctcaaaactgaaaacgttgg

SEQ ID NO: 2203 - DNA, 23 bp, Artificial Sequence
  Synthetic polynucleotide
atttgccacatccaaccccagag

SEQ ID NO: 2204 - DNA, 23 bp, Artificial Sequence
  Synthetic polynucleotide
ttaaagttctggaagctgggaag

SEQ ID NO: 2205 - DNA, 23 bp, Artificial Sequence
  Synthetic polynucleotide
gagtgagttagatatcacaagag

SEQ ID NO: 2206 - DNA, 23 bp, Artificial Sequence
  Synthetic polynucleotide
aaaaagacggacggatcatgagg

SEQ ID NO: 2207 - DNA, 23 bp, Artificial Sequence
  Synthetic polynucleotide
tgtagtctcagctactagggagg

SEQ ID NO: 2208 - DNA, 23 bp, Artificial Sequence
  Synthetic polynucleotide
gtacagtggtacatagaccccgg

SEQ ID NO: 2209 - DNA, 23 bp, Artificial Sequence
  Synthetic polynucleotide
tactcactctttggggaccgggg

SEQ ID NO: 2210 - DNA, 23 bp, Artificial Sequence
  Synthetic polynucleotide
cagtagggagtggctatccgggg

SEQ ID NO: 2211 - DNA, 23 bp, Artificial Sequence
  Synthetic polynucleotide
tctgggaagacatcacaaggagg

SEQ ID NO: 2212 - DNA, 23 bp, Artificial Sequence
  Synthetic polynucleotide
aggcagataggcattcaaggcag

SEQ ID NO: 2213 - DNA, 23 bp, Artificial Sequence
  Synthetic polynucleotide
ccctactatgtttatcacgtagg

SEQ ID NO: 2214 - DNA, 23 bp, Artificial Sequence
  Synthetic polynucleotide
gagtgcctacgtgataaacatag

SEQ ID NO: 2215 - DNA, 23 bp, Artificial Sequence
  Synthetic polynucleotide
agagttgaatagttgcaacggag

SEQ ID NO: 2216 - DNA, 23 bp, Artificial Sequence
  Synthetic polynucleotide
accactaggctactatcaggtgg

SEQ ID NO: 2217 - DNA, 23 bp, Artificial Sequence
  Synthetic polynucleotide
tccacctgatagtagcctagtgg

SEQ ID NO: 2218 - DNA, 23 bp, Artificial Sequence
  Synthetic polynucleotide
cctagtggttgtgagtacagcag

SEQ ID NO: 2219 - DNA, 23 bp, Artificial Sequence
  Synthetic polynucleotide
tcaggaaccatatcttacgttgg

SEQ ID NO: 2220 - DNA, 23 bp, Artificial Sequence
  Synthetic polynucleotide
tctaacctccaaaagtgtgagag

SEQ ID NO: 2221 - DNA, 23 bp, Artificial Sequence
  Synthetic polynucleotide
actggcatccttactagtagagg

SEQ ID NO: 2222 - DNA, 23 bp, Artificial Sequence
  Synthetic polynucleotide
ccattttagttacttcaccgaag

SEQ ID NO: 2223 - DNA, 23 bp, Artificial Sequence
  Synthetic polynucleotide
ggagaatcacttgaaccagggag

SEQ ID NO: 2224 - DNA, 23 bp, Artificial Sequence
  Synthetic polynucleotide
ggggtgccaagaatacacaatag

SEQ ID NO: 2225 - DNA, 23 bp, Artificial Sequence
  Synthetic polynucleotide
ttataatcccagcaactcgggag

SEQ ID NO: 2226 - DNA, 23 bp, Artificial Sequence
  Synthetic polynucleotide
ggaggatcactgaagcccaagag

SEQ ID NO: 2227 - DNA, 23 bp, Artificial Sequence
  Synthetic polynucleotide
attgttagtgtatagaaacgcag

SEQ ID NO: 2228 - DNA, 23 bp, Artificial Sequence
  Synthetic polynucleotide
acagcactagaagtcctagccag

SEQ ID NO: 2229 - DNA, 23 bp, Artificial Sequence
  Synthetic polynucleotide
attgaatacgatgttagctgtgg

SEQ ID NO: 2230 - DNA, 23 bp, Artificial Sequence
  Synthetic polynucleotide
gctactataacagaataccacag

SEQ ID NO: 2231 - DNA, 23 bp, Artificial Sequence
  Synthetic polynucleotide
atggaaagttcatgactgagggg

SEQ ID NO: 2232 - DNA, 23 bp, Artificial Sequence
  Synthetic polynucleotide
gcaattgtgacagaattgggagg

SEQ ID NO: 2233 - DNA, 23 bp, Artificial Sequence
  Synthetic polynucleotide
catgtactacgaccaagtgggag

SEQ ID NO: 2234 - DNA, 23 bp, Artificial Sequence
  Synthetic polynucleotide
atcatgtactacgaccaagtggg

SEQ ID NO: 2235 - DNA, 23 bp, Artificial Sequence
  Synthetic polynucleotide
gatcatgtactacgaccaagtgg

SEQ ID NO: 2236 - DNA, 23 bp, Artificial Sequence
  Synthetic polynucleotide
ggacaactcccacttggtcgtag

SEQ ID NO: 2237 - DNA, 23 bp, Artificial Sequence
  Synthetic polynucleotide
aagggtaacaacacacactgggg

SEQ ID NO: 2238 - DNA, 23 bp, Artificial Sequence
  Synthetic polynucleotide
ctatcaacagagtaagcagacag

SEQ ID NO: 2239 - DNA, 23 bp, Artificial Sequence
  Synthetic polynucleotide
atgggtgccgcacaccaacatgg

SEQ ID NO: 2240 - DNA, 23 bp, Artificial Sequence
  Synthetic polynucleotide
gcatccctcagataaatcccaag

SEQ ID NO: 2241 - DNA, 23 bp, Artificial Sequence
  Synthetic polynucleotide
ttgaacaactcataattacgtgg

SEQ ID NO: 2242 - DNA, 23 bp, Artificial Sequence
  Synthetic polynucleotide
gtagcctaatggtttccatgggg

SEQ ID NO: 2243 - DNA, 23 bp, Artificial Sequence
  Synthetic polynucleotide
caagtacaaaaaacgatgggggg

SEQ ID NO: 2244 - DNA, 23 bp, Artificial Sequence
  Synthetic polynucleotide
atagtttctcaacccttgggaag

SEQ ID NO: 2245 - DNA, 23 bp, Artificial Sequence
  Synthetic polynucleotide
gaaaaactcatgcacaccagagg

SEQ ID NO: 2246 - DNA, 23 bp, Artificial Sequence
  Synthetic polynucleotide
tgcagcaacaccataacagtagg

SEQ ID NO: 2247 - DNA, 23 bp, Artificial Sequence
  Synthetic polynucleotide
gtaaccaaaagagagcaatgggg

SEQ ID NO: 2248 - DNA, 23 bp, Artificial Sequence
  Synthetic polynucleotide
attgcctcatgataaccacaagg

SEQ ID NO: 2249 - DNA, 23 bp, Artificial Sequence
  Synthetic polynucleotide
catggtaaagagcaacacaagag

SEQ ID NO: 2250 - DNA, 23 bp, Artificial Sequence
  Synthetic polynucleotide
gctcttttaaagtttccactgag

SEQ ID NO: 2251 - DNA, 23 bp, Artificial Sequence
  Synthetic polynucleotide
tgaagtttagcaaagtaccagag

SEQ ID NO: 2252 - DNA, 23 bp, Artificial Sequence
  Synthetic polynucleotide
aaagggataaaagaaatccgcag

SEQ ID NO: 2253 - DNA, 23 bp, Artificial Sequence
  Synthetic polynucleotide
gcatgccaagaacttgacagaag

SEQ ID NO: 2254 - DNA, 23 bp, Artificial Sequence
  Synthetic polynucleotide
cttatgagtgagaacatgcagag

SEQ ID NO: 2255 - DNA, 23 bp, Artificial Sequence
  Synthetic polynucleotide
cctcacaaaaacaagcaacgggg

SEQ ID NO: 2256 - DNA, 23 bp, Artificial Sequence
  Synthetic polynucleotide
tcaagtgatttcgcccacctcgg

SEQ ID NO: 2257 - DNA, 23 bp, Artificial Sequence
  Synthetic polynucleotide
gtaggaacacttgaagccaggag

SEQ ID NO: 2258 - DNA, 23 bp, Artificial Sequence
  Synthetic polynucleotide
caggagttctagatcagcctggg

SEQ ID NO: 2259 - DNA, 23 bp, Artificial Sequence
  Synthetic polynucleotide
ccaaagtgatgggattgcagggg

SEQ ID NO: 2260 - DNA, 23 bp, Artificial Sequence
  Synthetic polynucleotide
ataagaactgagctttagagaag

SEQ ID NO: 2261 - DNA, 23 bp, Artificial Sequence
  Synthetic polynucleotide
agttcttatatagcaaaccggag

SEQ ID NO: 2262 - DNA, 23 bp, Artificial Sequence
  Synthetic polynucleotide
aagactgatgaatccagccaggg

SEQ ID NO: 2263 - DNA, 23 bp, Artificial Sequence
  Synthetic polynucleotide
atccaagtcattagtcttggggg

SEQ ID NO: 2264 - DNA, 23 bp, Artificial Sequence
  Synthetic polynucleotide
ataagatggtcacagcttggggg

SEQ ID NO: 2265 - DNA, 23 bp, Artificial Sequence
  Synthetic polynucleotide
ctcccatatttagcccaatgggg

SEQ ID NO: 2266 - DNA, 23 bp, Artificial Sequence
  Synthetic polynucleotide
tcctgcctcagccttccgaggag

SEQ ID NO: 2267 - DNA, 23 bp, Artificial Sequence
  Synthetic polynucleotide
ggagaatcgcttgaacccaggag

SEQ ID NO: 2268 - DNA, 23 bp, Artificial Sequence
  Synthetic polynucleotide
ttgagtcctagataggtgggtgg

SEQ ID NO: 2269 - DNA, 23 bp, Artificial Sequence
  Synthetic polynucleotide
gactcaagatcctagataggtgg

SEQ ID NO: 2270 - DNA, 23 bp, Artificial Sequence
  Synthetic polynucleotide
tgagtcctagataggtgggtggg

SEQ ID NO: 2271 - DNA, 23 bp, Artificial Sequence
  Synthetic polynucleotide
gactcaagatcctagataggtgg

SEQ ID NO: 2272 - DNA, 23 bp, Artificial Sequence
  Synthetic polynucleotide
aaattgggctgggaccacttagg

SEQ ID NO: 2273 - DNA, 23 bp, Artificial Sequence
  Synthetic polynucleotide
gactcaagatcctagataggtgg

SEQ ID NO: 2274 - DNA, 23 bp, Artificial Sequence
  Synthetic polynucleotide
tgcatgaaaacctatcccctggg

SEQ ID NO: 2275 - DNA, 23 bp, Artificial Sequence
  Synthetic polynucleotide
tgggagatcaacatgcctagtgg

SEQ ID NO: 2276 - DNA, 23 bp, Artificial Sequence
  Synthetic polynucleotide
aattacctcccacagcagcacag

SEQ ID NO: 2277 - DNA, 23 bp, Artificial Sequence
  Synthetic polynucleotide
gtattaccacttcgtgaaaagag

SEQ ID NO: 2278 - DNA, 23 bp, Artificial Sequence
  Synthetic polynucleotide
acaggttactcaaaagcccagag

SEQ ID NO: 2279 - DNA, 23 bp, Artificial Sequence
  Synthetic polynucleotide
gtattaccacttcgtgaaaagag

SEQ ID NO: 2280 - DNA, 23 bp, Artificial Sequence
  Synthetic polynucleotide
ggttactcaaaagcccagaggag

SEQ ID NO: 2281 - DNA, 23 bp, Artificial Sequence
  Synthetic polynucleotide
gtattaccacttcgtgaaaagag

SEQ ID NO: 2282 - DNA, 23 bp, Artificial Sequence
  Synthetic polynucleotide
tagatacccatcttatacacagg

SEQ ID NO: 2283 - DNA, 23 bp, Artificial Sequence
  Synthetic polynucleotide
gtctttaactatcatccatgtgg

SEQ ID NO: 2284 - DNA, 23 bp, Artificial Sequence
  Synthetic polynucleotide
tagatacccatcttatacacagg

SEQ ID NO: 2285 - DNA, 23 bp, Artificial Sequence
  Synthetic polynucleotide
taactatcatccatgtggaaggg

SEQ ID NO: 2286 - DNA, 23 bp, Artificial Sequence
  Synthetic polynucleotide
tttgcacaaaggattgtaggtgg

SEQ ID NO: 2287 - DNA, 23 bp, Artificial Sequence
  Synthetic polynucleotide
caagataccaaactaagaggtgg

SEQ ID NO: 2288 - DNA, 23 bp, Artificial Sequence
  Synthetic polynucleotide
tagctgagatccactcccctcgg

SEQ ID NO: 2289 - DNA, 23 bp, Artificial Sequence
  Synthetic polynucleotide
gatgtttgcttgagcccctgggg

SEQ ID NO: 2290 - DNA, 23 bp, Artificial Sequence
  Synthetic polynucleotide
ctttttcaatgaggaaaccgtgg

SEQ ID NO: 2291 - DNA, 23 bp, Artificial Sequence
  Synthetic polynucleotide
tataatcccagcactttgggagg

SEQ ID NO: 2292 - DNA, 23 bp, Artificial Sequence
  Synthetic polynucleotide
aataggagacatagttcctgagg

SEQ ID NO: 2293 - DNA, 23 bp, Artificial Sequence
  Synthetic polynucleotide
cactggtgaggaagttacacggg

SEQ ID NO: 2294 - DNA, 23 bp, Artificial Sequence
  Synthetic polynucleotide
aataggagacatagttcctgagg

SEQ ID NO: 2295 - DNA, 23 bp, Artificial Sequence
  Synthetic polynucleotide
acgggtagtctgttagaaagagg

SEQ ID NO: 2296 - DNA, 23 bp, Artificial Sequence
  Synthetic polynucleotide
ttagagccaaaggagcaagtaag

SEQ ID NO: 2297 - DNA, 23 bp, Artificial Sequence
  Synthetic polynucleotide
ttacactgtaaacggcctgagag

SEQ ID NO: 2298 - DNA, 23 bp, Artificial Sequence
  Synthetic polynucleotide
ctcagcttaatcgattttggggg

SEQ ID NO: 2299 - DNA, 23 bp, Artificial Sequence
  Synthetic polynucleotide
tagaccacaatttcacctggagg

SEQ ID NO: 2300 - DNA, 23 bp, Artificial Sequence
  Synthetic polynucleotide
taagggaacaccaaaagcacagg

SEQ ID NO: 2301 - DNA, 23 bp, Artificial Sequence
  Synthetic polynucleotide
tagccaaacctgctagaaagagg

SEQ ID NO: 2302 - DNA, 23 bp, Artificial Sequence
  Synthetic polynucleotide
ctatgcttctgaaagttagcaag

SEQ ID NO: 2303 - DNA, 23 bp, Artificial Sequence
  Synthetic polynucleotide
gcatagttactggagtgaggcag

SEQ ID NO: 2304 - DNA, 23 bp, Artificial Sequence
  Synthetic polynucleotide
ctatgcttctgaaagttagcaag

SEQ ID NO: 2305 - DNA, 23 bp, Artificial Sequence
  Synthetic polynucleotide
gcatagttactggagtgaggcag

SEQ ID NO: 2306 - DNA, 23 bp, Artificial Sequence
  Synthetic polynucleotide
tgtacatagacccagcacaaggg

SEQ ID NO: 2307 - DNA, 23 bp, Artificial Sequence
  Synthetic polynucleotide
agctatagtagaatcctgtgtgg

SEQ ID NO: 2308 - DNA, 23 bp, Artificial Sequence
  Synthetic polynucleotide
tccatcaccactacacacaatgg

SEQ ID NO: 2309 - DNA, 23 bp, Artificial Sequence
  Synthetic polynucleotide
cagagccttgacacctgccgtgg

SEQ ID NO: 2310 - DNA, 23 bp, Artificial Sequence
  Synthetic polynucleotide
gatctgtttataggccacagtgg

SEQ ID NO: 2311 - DNA, 23 bp, Artificial Sequence
  Synthetic polynucleotide
tctgtggcttatacaactggggg

SEQ ID NO: 2312 - DNA, 23 bp, Artificial Sequence
  Synthetic polynucleotide
gatctgtttataggccacagtgg

SEQ ID NO: 2313 - DNA, 23 bp, Artificial Sequence
  Synthetic polynucleotide
atctgtggcttatacaactgggg

SEQ ID NO: 2314 - DNA, 23 bp, Artificial Sequence
  Synthetic polynucleotide
cagtgacagatactggtccatgg

SEQ ID NO: 2315 - DNA, 23 bp, Artificial Sequence
  Synthetic polynucleotide
acccctgatctaacccactgtgg

SEQ ID NO: 2316 - DNA, 23 bp, Artificial Sequence
  Synthetic polynucleotide
tattgtgaactgcacatacgagg

SEQ ID NO: 2317 - DNA, 23 bp, Artificial Sequence
  Synthetic polynucleotide
gccaaggctgatctaacaggagg

SEQ ID NO: 2318 - DNA, 23 bp, Artificial Sequence
  Synthetic polynucleotide
tattgtgaactgcacatacgagg

SEQ ID NO: 2319 - DNA, 23 bp, Artificial Sequence
  Synthetic polynucleotide
tctctgagagtctaatgccaagg

SEQ ID NO: 2320 - DNA, 23 bp, Artificial Sequence
  Synthetic polynucleotide
attgtgaactgcacatacgaggg

SEQ ID NO: 2321 - DNA, 23 bp, Artificial Sequence
  Synthetic polynucleotide
gccaaggctgatctaacaggagg

SEQ ID NO: 2322 - DNA, 23 bp, Artificial Sequence
  Synthetic polynucleotide
attgtgaactgcacatacgaggg

SEQ ID NO: 2323 - DNA, 23 bp, Artificial Sequence
  Synthetic polynucleotide
tctctgagagtctaatgccaagg

SEQ ID NO: 2324 - DNA, 23 bp, Artificial Sequence
  Synthetic polynucleotide
aatggtgcagatagtaaggacag

SEQ ID NO: 2325 - DNA, 23 bp, Artificial Sequence
  Synthetic polynucleotide
ataaatctattccaagacaaaag

SEQ ID NO: 2326 - DNA, 23 bp, Artificial Sequence
  Synthetic polynucleotide
gagaggttatgtcatctccacag

SEQ ID NO: 2327 - DNA, 23 bp, Artificial Sequence
  Synthetic polynucleotide
gagttaataatcatgctccgaag

SEQ ID NO: 2328 - DNA, 23 bp, Artificial Sequence
  Synthetic polynucleotide
aaaatggacatggataccctagg

SEQ ID NO: 2329 - DNA, 23 bp, Artificial Sequence
  Synthetic polynucleotide
cattttagctagaaccagggtgg

SEQ ID NO: 2330 - DNA, 23 bp, Artificial Sequence
  Synthetic polynucleotide
aaaatggacatggataccctagg

SEQ ID NO: 2331 - DNA, 23 bp, Artificial Sequence
  Synthetic polynucleotide
gtccattttagctagaaccaggg

SEQ ID NO: 2332 - DNA, 23 bp, Artificial Sequence
  Synthetic polynucleotide
gtcactcaagagctctaacggag

SEQ ID NO: 2333 - DNA, 23 bp, Artificial Sequence
  Synthetic polynucleotide
ccaggcacattgtcaataggcag

SEQ ID NO: 2334 - DNA, 23 bp, Artificial Sequence
  Synthetic polynucleotide
agctctaacggagaggtacaagg

SEQ ID NO: 2335 - DNA, 23 bp, Artificial Sequence
  Synthetic polynucleotide
gttagagctcttgagtgaccagg

SEQ ID NO: 2336 - DNA, 23 bp, Artificial Sequence
  Synthetic polynucleotide
gctctaacggagaggtacaaggg

SEQ ID NO: 2337 - DNA, 23 bp, Artificial Sequence
  Synthetic polynucleotide
gttagagctcttgagtgaccagg

SEQ ID NO: 2338 - DNA, 23 bp, Artificial Sequence
  Synthetic polynucleotide
tttgggttactgtagccttgtag

SEQ ID NO: 2339 - DNA, 23 bp, Artificial Sequence
  Synthetic polynucleotide
gcatggtactggtaccaaaacag

SEQ ID NO: 2340 - DNA, 23 bp, Artificial Sequence
  Synthetic polynucleotide
acttacctcctgaatacggtgag

SEQ ID NO: 2341 - DNA, 23 bp, Artificial Sequence
  Synthetic polynucleotide
ggctttttatttgtatgcggcag

SEQ ID NO: 2342 - DNA, 23 bp, Artificial Sequence
  Synthetic polynucleotide
ttttgaggtcacatatgatgggg

SEQ ID NO: 2343 - DNA, 23 bp, Artificial Sequence
  Synthetic polynucleotide
gatggaaaagaggttaggcaggg

SEQ ID NO: 2344 - DNA, 23 bp, Artificial Sequence
  Synthetic polynucleotide
gacagctccaccgaaacaggagg

SEQ ID NO: 2345 - DNA, 23 bp, Artificial Sequence
  Synthetic polynucleotide
tttactctttcactttcacgagg

SEQ ID NO: 2346 - DNA, 23 bp, Artificial Sequence
  Synthetic polynucleotide
taccaggcccatccttcccgagg

SEQ ID NO: 2347 - DNA, 23 bp, Artificial Sequence
  Synthetic polynucleotide
gggcctggtagagtgagtatggg

SEQ ID NO: 2348 - DNA, 23 bp, Artificial Sequence
  Synthetic polynucleotide
ggtttgtataagtgcaccctagg

SEQ ID NO: 2349 - DNA, 23 bp, Artificial Sequence
  Synthetic polynucleotide
gtataggctaccatacacctagg

SEQ ID NO: 2350 - DNA, 23 bp, Artificial Sequence
  Synthetic polynucleotide
caccctaggatgtttgcacaagg

SEQ ID NO: 2351 - DNA, 23 bp, Artificial Sequence
  Synthetic polynucleotide
gtataggctaccatacacctagg

SEQ ID NO: 2352 - DNA, 23 bp, Artificial Sequence
  Synthetic polynucleotide
ataggcgagcacatgaaaagagg

SEQ ID NO: 2353 - DNA, 23 bp, Artificial Sequence
  Synthetic polynucleotide
tatgcccttcgacaccaaggtgg

SEQ ID NO: 2354 - DNA, 23 bp, Artificial Sequence
  Synthetic polynucleotide
tgctaaatgtgtatcacccgagg

SEQ ID NO: 2355 - DNA, 23 bp, Artificial Sequence
  Synthetic polynucleotide
tttgggtggtacctgattggggg

SEQ ID NO: 2356 - DNA, 23 bp, Artificial Sequence
  Synthetic polynucleotide
tgctaaatgtgtatcacccgagg

SEQ ID NO: 2357 - DNA, 23 bp, Artificial Sequence
  Synthetic polynucleotide
atttgggtggtacctgattgggg

SEQ ID NO: 2358 - DNA, 23 bp, Artificial Sequence
  Synthetic polynucleotide
ataattctgcacaaatccccaag

SEQ ID NO: 2359 - DNA, 23 bp, Artificial Sequence
  Synthetic polynucleotide
ttataagcagggaggcctgagag

SEQ ID NO: 2360 - DNA, 23 bp, Artificial Sequence
  Synthetic polynucleotide
gtaacatcagccaagccagtagg

SEQ ID NO: 2361 - DNA, 23 bp, Artificial Sequence
  Synthetic polynucleotide
ttactgctgcgtcgctcctgggg

SEQ ID NO: 2362 - DNA, 23 bp, Artificial Sequence
  Synthetic polynucleotide
taggtccccaccaatgctgccgg

SEQ ID NO: 2363 - DNA, 23 bp, Artificial Sequence
  Synthetic polynucleotide
ttactgctgcgtcgctcctgggg

SEQ ID NO: 2364 - DNA, 23 bp, Artificial Sequence
  Synthetic polynucleotide
tgctgtggactgcaacggtgtgg

SEQ ID NO: 2365 - DNA, 23 bp, Artificial Sequence
  Synthetic polynucleotide
gttcaccggcagcattggtgggg

SEQ ID NO: 2366 - DNA, 23 bp, Artificial Sequence
  Synthetic polynucleotide
tgctgtggactgcaacggtgtgg

SEQ ID NO: 2367 - DNA, 23 bp, Artificial Sequence
  Synthetic polynucleotide
ttggtggggacctactggcttgg

SEQ ID NO: 2368 - DNA, 23 bp, Artificial Sequence
  Synthetic polynucleotide
tgcattaccaatatcagcaaggg

SEQ ID NO: 2369 - DNA, 23 bp, Artificial Sequence
  Synthetic polynucleotide
tgcagcatagcatagtgagtggg

SEQ ID NO: 2370 - DNA, 23 bp, Artificial Sequence
  Synthetic polynucleotide
tgcattaccaatatcagcaaggg

SEQ ID NO: 2371 - DNA, 23 bp, Artificial Sequence
  Synthetic polynucleotide
atgcagcatagcatagtgagtgg

SEQ ID NO: 2372 - DNA, 23 bp, Artificial Sequence
  Synthetic polynucleotide
gtaagagacaaccattacaggag

SEQ ID NO: 2373 - DNA, 23 bp, Artificial Sequence
  Synthetic polynucleotide
ggaagacctcatgaactgagcag

SEQ ID NO: 2374 - DNA, 23 bp, Artificial Sequence
  Synthetic polynucleotide
cccccacattcccattgtggggg

SEQ ID NO: 2375 - DNA, 23 bp, Artificial Sequence
  Synthetic polynucleotide
gacctggggcatattgtcagggg

SEQ ID NO: 2376 - DNA, 23 bp, Artificial Sequence
  Synthetic polynucleotide
cccccacattcccattgtggggg

SEQ ID NO: 2377 - DNA, 23 bp, Artificial Sequence
  Synthetic polynucleotide
ggggtgaagtgttagacccaggg

SEQ ID NO: 2378 - DNA, 23 bp, Artificial Sequence
  Synthetic polynucleotide
cccccacattcccattgtggggg

SEQ ID NO: 2379 - DNA, 23 bp, Artificial Sequence
  Synthetic polynucleotide
gttagacccagggaccaggtggg

SEQ ID NO: 2380 - DNA, 23 bp, Artificial Sequence
  Synthetic polynucleotide
taagactagcctctatagcaagg

SEQ ID NO: 2381 - DNA, 23 bp, Artificial Sequence
  Synthetic polynucleotide
ttacacatggctataaggtgcgg

SEQ ID NO: 2382 - DNA, 23 bp, Artificial Sequence
  Synthetic polynucleotide
tctctcatcaggtatccagaagg

SEQ ID NO: 2383 - DNA, 23 bp, Artificial Sequence
  Synthetic polynucleotide
ccaactgtgacaagtcaacgtgg

SEQ ID NO: 2384 - DNA, 23 bp, Artificial Sequence
  Synthetic polynucleotide
gttatctcaaaggtacccatgag

SEQ ID NO: 2385 - DNA, 23 bp, Artificial Sequence
  Synthetic polynucleotide
cactgactatctcttcagagaag

SEQ ID NO: 2386 - DNA, 23 bp, Artificial Sequence
  Synthetic polynucleotide
ggagaagggtataaccttggggg

SEQ ID NO: 2387 - DNA, 23 bp, Artificial Sequence
  Synthetic polynucleotide
cctgcatccaatgaatggtgtgg

SEQ ID NO: 2388 - DNA, 23 bp, Artificial Sequence
  Synthetic polynucleotide
agaccaccgtccagaaagaagag

SEQ ID NO: 2389 - DNA, 23 bp, Artificial Sequence
  Synthetic polynucleotide
ggattattctctctggacagtag

SEQ ID NO: 2390 - DNA, 23 bp, Artificial Sequence
  Synthetic polynucleotide
agaccaccgtccagaaagaagag

SEQ ID NO: 2391 - DNA, 23 bp, Artificial Sequence
  Synthetic polynucleotide
tctggattattctctctggacag

SEQ ID NO: 2392 - DNA, 23 bp, Artificial Sequence
  Synthetic polynucleotide
agagatgcacaatagcccgacag

SEQ ID NO: 2393 - DNA, 23 bp, Artificial Sequence
  Synthetic polynucleotide
ggattattctctctggacagtag

SEQ ID NO: 2394 - DNA, 23 bp, Artificial Sequence
  Synthetic polynucleotide
agagatgcacaatagcccgacag

SEQ ID NO: 2395 - DNA, 23 bp, Artificial Sequence
  Synthetic polynucleotide
tctggattattctctctggacag

SEQ ID NO: 2396 - DNA, 23 bp, Artificial Sequence
  Synthetic polynucleotide
tcagggtctagaaagacgaacag

SEQ ID NO: 2397 - DNA, 23 bp, Artificial Sequence
  Synthetic polynucleotide
tacgtttctgaaattgcaagcag

SEQ ID NO: 2398 - DNA, 23 bp, Artificial Sequence
  Synthetic polynucleotide
tcactgcaaacacaaccctgagg

SEQ ID NO: 2399 - DNA, 23 bp, Artificial Sequence
  Synthetic polynucleotide
gcaaccttgagacatgaggtagg

SEQ ID NO: 2400 - DNA, 23 bp, Artificial Sequence
  Synthetic polynucleotide
tcactgcaaacacaaccctgagg

SEQ ID NO: 2401 - DNA, 23 bp, Artificial Sequence
  Synthetic polynucleotide
gtgagcaaccttgagacatgagg

SEQ ID NO: 2402 - DNA, 23 bp, Artificial Sequence
  Synthetic polynucleotide
gtttacatattattttaacgaag

SEQ ID NO: 2403 - DNA, 23 bp, Artificial Sequence
  Synthetic polynucleotide
tccatcatccaagtattcaacag

SEQ ID NO: 2404 - DNA, 23 bp, Artificial Sequence
  Synthetic polynucleotide
aatcattgtaacaagccctacag

SEQ ID NO: 2405 - DNA, 23 bp, Artificial Sequence
  Synthetic polynucleotide
atttgccacatccaaccccagag

SEQ ID NO: 2406 - DNA, 23 bp, Artificial Sequence
  Synthetic polynucleotide
ttgctggtgggcacaccagagag

SEQ ID NO: 2407 - DNA, 23 bp, Artificial Sequence
  Synthetic polynucleotide
accagcaagaaagttcccaccag

SEQ ID NO: 2408 - DNA, 23 bp, Artificial Sequence
  Synthetic polynucleotide
ctatattccattcatgaaggcag

SEQ ID NO: 2409 - DNA, 23 bp, Artificial Sequence
  Synthetic polynucleotide
gagtgagttagatatcacaagag

SEQ ID NO: 2410 - DNA, 23 bp, Artificial Sequence
  Synthetic polynucleotide
tgtagtctcagctactagggagg

SEQ ID NO: 2411 - DNA, 23 bp, Artificial Sequence
  Synthetic polynucleotide
aggtgagcaccactatgcccggg

SEQ ID NO: 2412 - DNA, 23 bp, Artificial Sequence
  Synthetic polynucleotide
cactcccatcaacagtgtgtagg

SEQ ID NO: 2413 - DNA, 23 bp, Artificial Sequence
  Synthetic polynucleotide
aaccataatggaagactgtgtgg

SEQ ID NO: 2414 - DNA, 23 bp, Artificial Sequence
  Synthetic polynucleotide
gtagcctaatggtttccatgggg

SEQ ID NO: 2415 - DNA, 23 bp, Artificial Sequence
  Synthetic polynucleotide
cgttttccagccgctccctgtgg

SEQ ID NO: 2416 - DNA, 23 bp, Artificial Sequence
  Synthetic polynucleotide
catgaccctgtagatactgaagg

SEQ ID NO: 2417 - DNA, 23 bp, Artificial Sequence
  Synthetic polynucleotide
tcatggtttcagaaccccaaggg

SEQ ID NO: 2418 - DNA, 23 bp, Artificial Sequence
  Synthetic polynucleotide
tttcagtccccattaatgaacag

SEQ ID NO: 2419 - DNA, 23 bp, Artificial Sequence
  Synthetic polynucleotide
gcatgccaagaacttgacagaag

SEQ ID NO: 2420 - DNA, 23 bp, Artificial Sequence
  Synthetic polynucleotide
tttcagtccccattaatgaacag

SEQ ID NO: 2421 - DNA, 23 bp, Artificial Sequence
  Synthetic polynucleotide
acagcatgccaagaacttgacag

SEQ ID NO: 2422 - DNA, 23 bp, Artificial Sequence
  Synthetic polynucleotide
ttttggttactgtagccttgtag

SEQ ID NO: 2423 - DNA, 23 bp, Artificial Sequence
  Synthetic polynucleotide
gcatggtactggtaccaaaacag

SEQ ID NO: 2424 - DNA, 23 bp, Artificial Sequence
  Synthetic polynucleotide
catgacctgccaacatgctgggg

SEQ ID NO: 2425 - DNA, 23 bp, Artificial Sequence
  Synthetic polynucleotide
caggagtttgagactagcctggg

SEQ ID NO: 2426 - protein, 1368 aa, S. pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 2427 - protein, 1368 aa, S. pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 2428 - protein, 1368 aa, S. pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 2429 - protein, 1388 aa, Streptococcus thermophilus
MTKPYSIGLAIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 2430 - protein, 120 aa, Artificial Sequence
  Synthetic polypeptide
  MISC_FEATURE (5)..(120)
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 2431 - protein, 7 aa, Artificial Sequence
  Synthetic polypeptide
PKKKRKV

SEQ ID NO: 2432 - protein, 30 aa, Artificial Sequence
  Synthetic polypeptide
MDSLLMNRRKFLYQFKNVRWAKGRRETYLC

SEQ ID NO: 2433 - DNA, 6000 bp, Homo sapiens
gaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagagggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttaca

SEQ ID NO: 2434 - protein, 1977 aa, Homo sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 2435 - DNA, 12851 bp, Homo sapiens
cggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttctttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatacccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaattataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcactcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactattatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggtgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagaatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatataacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttcttgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaattttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttacccaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaatcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaactttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggtctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagctgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataa

SEQ ID NO: 2436 - protein, 1956 aa, Homo sapiens
MEFPIGSLETNNFRRFTPESLVEIEKQIAAKQGTKKAREKHREQKDQEEKPRPQLDLKACNQLPKFYGELPAELIGEPLEDLDPFYSTHRTFMVLNKGRTISRFSATRALWLFSPFNLIRRTAIKVSVHSWFSLFITVTILVNCVCMTRTDLPEKIEYVFTVIYTFEALIKILARGFCLNEFTYLRDPWNWLDFSVITLAYVGTAIDLRGISGLRTFRVLRALKTVSVIPGLKVIVGALIHSVKKLADVTILTIFCLSVFALVGLQLFKGNLKNKCVKNDMAVNETTNYSSHRKPDIYINKRGTSDPLLCGNGSDSGHCPDGYICLKTSDNPDFNYTSFDSFAWAFLSLFRLMTQDSWERLYQQTLRTSGKIYMIFFVLVIFLGSFYLVNLILAVVTMAYEEQNQATTDEIEAKEKKFQEALEMLRKEQEVLAALGIDTTSLHSHNGSPLTSKNASERRHRIKPRVSEGSTEDNKSPRSDPYNQRRMSFLGLASGKRRASHGSVFHFRSPGRDISLPEGVTDDGVFPGDHESHRGSLLLGGGAGQQGPLPRSPLPQPSNPDSRHGEDEHQPPPTSELAPGAVDVSAFDAGQKKTFLSAEYLDEPFRAQRAMSVVSIITSVLEELEESEQKCPPCLTSLSQKYLIWDCCPMWVKLKTILFGLVTDPFAELTITLCIVVNTIFMAMEHHGMSPTFEAMLQIGNIVFTIFFTAEMVFKIIAFDPYYYFQKKWNIFDCIIVTVSLLELGVAKKGSLSVLRSFRLLRVFKLAKSWPTLNTLIKIIGNSVGALGNLTIILAIIVFVFALVGKQLLGENYRNNRKNISAPHEDWPRWHMHDFFHSFLIVFRILCGEWIENMWACMEVGQKSICLILFLTVMVLGNLVVLNLFIALLLNSFSADNLTAPEDDGEVNNLQVALARIQVFGHRTKQALCSFFSRSCPFPQPKAEPELVVKLPLSSSKAENHIAANTARGSSGGLQAPRGPRDEHSDFIANPTVWVSVPIAEGESDLDDLEDDGGEDAQSFQQEVIPKGQQEQLQQVERCGDHLTPRSPGTGTSSEDLAPSLGETWKDESVPQVPAEGVDDTSSSEGSTVDCLDPEEILRKIPELADDLEEPDDCFTEGCIRHCPCCKLDTTKSPWDVGWQVRKTCYRIVEHSWFESFIIFMILLSSGSLAFEDYYLDQKPTVKALLEYTDRVFTFIFVFEMLLKWVAYGFKKYFTNAWCWLDFLIVNISLISLTAKILEYSEVAPIKALRTLRALRPLRALSRFEGMRVVVDALVGAIPSIMNVLLVCLIFWLIFSIMGVNLFAGKFWRCINYTDGEFSLVPLSIVNNKSDCKIQNSTGSFFWVNVKVNFDNVAMGYLALLQVATFKGWMDIMYAAVDSREVNMQPKWEDNVYMYLYFVIFIIFGGFFTLNLFVGVIIDNFNQQKKKLGGQDIFMTEEQKKYYNAMKKLGSKKPQKPIPRPLNKFQGFVFDIVTRQAFDITIMVLICLNMITMMVETDDQSEEKTKILGKINQFFVAVFTGECVMKMFALRQYYFTNGWNVFDFIVVVLSIASLIFSAILKSLQSYFSPTLFRVIRLARIGRILRLIRAAKGIRTLLFALMMSLPALFNIGLLLFLVMFIYSIFGMSSFPHVRWEAGIDDMFNFQTFANSMLCLFQITTSAGWDGLLSPILNTGPPYCDPNLPNSNGTRGDCGSPAVGIIFFTTYIIISFLIMVNMYIAVILENFNVATEESTEPLSEDDFDMFYETWEKFDPEATQFITFSALSDFADTLSGPLRIPKPNRNILIQMDLPLVPGDKIHCLDILFAFTKNVLGESGELDSLKANMEEKFMATNLSKSSYEPIATTLRWKQEDISATVIQKAYRSYVLHRSMALSNTPCVPRAEEEAASLPDEGFVAFTANENCVLPDKSETASATSFPPSYESVTRGLSDRVNMRTSSSIQNEDEATSMELIAPGP

SEQ ID NO: 2437 - protein, 1791 aa, Homo sapiens
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSTMISTLENQEHIPFPPTLFRIVRLARIGRILRLVRAARGIRTLLFALMMSLPSLFNIGLLLFLIMFIYAILGMNWFSKVNPESGIDDIFNFKTFASSMLCLFQISTSAGWDSLLSPMLRSKESCNSSSENCHLPGIATSYFVSYIIISFLIVVNMYIAVILENFNTATEESEDPLGEDDFDIFYEVWEKFDPEATQFIKYSALSDFADALPEPLRVAKPNKYQFLVMDLPMVSEDRLHCMDILFAFTARVLGGSDGLDSMKAMMEEKFMEANPLKKLYEPIVTTTKRKEEERGAAIIQKAFRKYMMKVTKGDQGDQNDLENGPHSPLQTLCNGDLSSFGVAKGKVHCD

SEQ ID NO: 2438 - protein, 2000 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 2439 - protein, 2353 aa, Homo sapiens
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRSTFPSPEAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 2440 - protein, 890 aa, Homo sapiens
MEGGGKPNSSSNSRDDGNSVFPAKASATGAGPAAAEKRLGTPPGGGGAGAKEHGNSVCFKVDGGGGGGGGGGGGEEPAGGFEDAEGPRRQYGFMQRQFTSMLQPGVNKFSLRMFGSQKAVEKEQERVKTAGFWIIHPYSDFRFYWDLIMLIMMVGNLVIIPVGITFFTEQTTTPWIIFNVASDTVFLLDLIMNFRTGTVNEDSSEIILDPKVIKMNYLKSWFVVDFISSIPVDYIFLIVEKGMDSEVYKTARALRIVRFTKILSLLRLLRLSRLIRYIHQWEEIFHMTYDLASAVVRIFNLIGMMLLLCHWDGCLQFLVPLLQDFPPDCWVSLNEMVNDSWGKQYSYALFKAMSHMLCIGYGAQAPVSMSDLWITMLSMIVGATCYAMFVGHATALIQSLDSSRRQYQEKYKQVEQYMSFHKLPADMRQKIHDYYEHRYQGKIFDEENILNELNDPLREEIVNFNCRKLVATMPLFANADPNFVTAMLSKLRFEVFQPGDYIIREGAVGKKMYFIQHGVAGVITKSSKEMKLTDGSYFGEICLLTKGRRTASVRADTYCRLYSLSVDNFNEVLEEYPMMRRAFETVAIDRLDRIGKKNSILLQKFQKDLNTGVFNNQENEILKQIVKHDREMVQAIAPINYPQMTTLNSTSSTTTPTSRMRTQSPPVYTATSLSHSNLHSPSPSTQTPQPSAILSPCSYTTAVCSPPVQSPLAARTFHYASPTASQLSLMQQQPQQQVQQSQPPQTQPQQPSPQPQTPGSSTPKNEVHKSTQALHNTNLTREVRPLSASQPSLPHEVSTLISRPHPTVGESLASIPQPVTAVPGTGLQAGGRSTVPQRVTLFRQMSSGAIPPNRGVPPAPPPPAAALPRESSSVLNTDPDAEKPRFASNL

SEQ ID NO: 2441 - protein, 889 aa, Homo sapiens
MDARGGGGRPGESPGATPAPGPPPPPPPAPPQQQPPPPPPPAPPPGPGPAPPQHPPRAEALPPEAADEGGPRGRLRSRDSSCGRPGTPGAASTAKGSPNGECGRGEPQCSPAGPEGPARGPKVSFSCRGAASGPAPGPGPAEEAGSEEAGPAGEPRGSQASFMQRQFGALLQPGVNKFSLRMFGSQKAVEREQERVKSAGAWIIHPYSDFRFYWDFTMLLFMVGNLIIIPVGITFFKDETTAPWIVFNVVSDTFFLMDLVLNFRTGIVIEDNTEIILDPEKIKKKYLRTWFVVDFVSSIPVDYIFLIVEKGIDSEVYKTARALRIVRFTKILSLLRLLRLSRLIRYIHQWEEIFHMTYDLASAVMRICNLISMMLLLCHWDGCLQFLVPMLQDFPRNCWVSINGMVNHSWSELYSFALFKAMSHMLCIGYGRQAPESMTDIWLTMLSMIVGATCYAMFIGHATALIQSLDSSRRQYQEKYKQVEQYMSFHKLPADFRQKIHDYYEHRYQGKMFDEDSILGELNGPLREEIVNFNCRKLVASMPLFANADPNFVTAMLTKLKFEVFQPGDYIIREGTIGKKMYFIQHGVVSVLTKGNKEMKLSDGSYFGEICLLTRGRRTASVRADTYCRLYSLSVDNFNEVLEEYPMMRRAFETVAIDRLDRIGKKNSILLHKVQHDLNSGVFNNQENAIIQEIVKYDREMVQQAELGQRVGLFPPPPPPPQVTSAIATLQQAAAMSFCPQVARPLVGPLALGSPRLVRRPPPGPAPAAASPGPPPPASPPGAPASPRAPRTSPYGGLPAAPLAGPALPARRLSRASRPLSASQPSLPHGAPGPAASTRPASSSTPRLGPTPAARAAAPSPDRRDSASPGAAGGLDPQDSARSRLSSNL

SEQ ID NO: 2442 - protein, 986 aa, Homo sapiens
MRVNEKYSTLPAEDRSVHIINICAIEDIGYLPSEGTLLNSLSVDPDAECKYGLYFRDGRRKVDYILVYHHKRPSGNRTLVRRVQHSDTPSGARSVKQDHPLPGKGASLDAGSGEPPMDYHEDDKRFRREEYEGNLLEAGLELERDEDTKIHGVGFVKIHAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEEAVKDHPRAEYEARVLEKSLKKESRNKEKRRHIPEESTNKWKQRVKTAMAGVKLTDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 2443 - DNA, 32 bp, Artificial Sequence
  Synthetic polynucleotide
tccagccagttccaagggtcacggaggaaggt

SEQ ID NO: 2444 - DNA, 36 bp, Artificial Sequence
  Synthetic polynucleotide
tccagccagttccaagggtcacggaggaaggtgaat

SEQ ID NO: 2445 - DNA, 32 bp, Artificial Sequence
  Synthetic polynucleotide
ctaccctgttccgagtcattcgcctggccagg

SEQ ID NO: 2446 - DNA, 33 bp, Artificial Sequence
  Synthetic polynucleotide
caaaaatgttccatcccacagtgaagtagtaat

SEQ ID NO: 2447 - RNA, 20 nt, Artificial Sequence
  Synthetic polynucleotide
gccaguuccaagggucacgg

SEQ ID NO: 2448 - RNA, 20 nt, Artificial Sequence
  Synthetic polynucleotide
gccaguuccaagggucacgg

SEQ ID NO: 2449 - RNA, 20 nt, Artificial Sequence
  Synthetic polynucleotide
gccaguuccaagggucacgg

SEQ ID NO: 2450 - RNA, 20 nt, Artificial Sequence
  Synthetic polynucleotide
guuccaagggucacggagga

SEQ ID NO: 2451 - RNA, 21 nt, Artificial Sequence
  Synthetic polynucleotide
ccaguuccaagggucacggag

SEQ ID NO: 2452 - RNA, 20 nt, Artificial Sequence
  Synthetic polynucleotide
ccuguuccgagucauucgcc

SEQ ID NO: 2453 - RNA, 21 nt, Artificial Sequence
  Synthetic polynucleotide
uguuccaucccacagugaagu

SEQ ID NO: 2454 - RNA, 21 nt, Artificial Sequence
  Synthetic polynucleotide
aaauguuccaucccacaguga

SEQ ID NO: 2455 - RNA, 20 nt, Artificial Sequence
  Synthetic polynucleotide
gacccccuccaccccgccuc

SEQ ID NO: 2456 - RNA, 20 nt, Artificial Sequence
  Synthetic polynucleotide
ugugguagccauggcguacg

SEQ ID NO: 2457 - RNA, 20 nt, Artificial Sequence
  Synthetic polynucleotide
acagaagcuguccaguggcg

SEQ ID NO: 2458 - RNA, 20 nt, Artificial Sequence
  Synthetic polynucleotide
cugaguacacgaguuuaggg

SEQ ID NO: 2459 - RNA, 20 nt, Artificial Sequence
  Synthetic polynucleotide
gaaaagcuuccaucucggcg

SEQ ID NO: 2460 - RNA, 20 nt, Artificial Sequence
  Synthetic polynucleotide
ggugcccuuccacgccgaga

SEQ ID NO: 2461 - RNA, 20 nt, Artificial Sequence
  Synthetic polynucleotide
ugagcaaaucuguaccacca

SEQ ID NO: 2462 - RNA, 20 nt, Artificial Sequence
  Synthetic polynucleotide
uaucucaaaccguacccuug

SEQ ID NO: 2463 - RNA, 20 nt, Artificial Sequence
  Synthetic polynucleotide
caaggacacaaaacgaacag

SEQ ID NO: 2464 - RNA, 20 nt, Artificial Sequence
  Synthetic polynucleotide
guaguggucaacgcacucau

SEQ ID NO: 2465 - protein, 90 aa, Artificial Sequence
  Synthetic polypeptide
  MISC_FEATURE (4)..(90)
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 2466 - protein, 120 aa, Artificial Sequence
  Synthetic polypeptide
  MISC_FEATURE (5)..(120)
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 2467 - protein, 90 aa, Artificial Sequence; identical to SEQ ID NO: 2465
  Synthetic
  MISC_FEATURE (4)..(90): May be absent

SEQ ID NO: 2468 - protein, 120 aa, Artificial Sequence; identical to SEQ ID NO: 2466
  Synthetic
  MISC_FEATURE (5)..(120): May be absent

SEQ ID NO: 2469 - protein, 1210 aa, Uncultured Parcubacteria group bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 2470 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 2471 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 2472 - protein, 1050 aa, Artificial Sequence
  Synthetic
MRSNYHGGRNARQWRKQISGLARRTKETVFTYKFPLETDAAEIDFDKAVQTYGIAEGVGHGSLIGLVCAFHLSGFRLFSKAGEAMAFRNRSRYPTDAFAEKLSAIMGIQLPTLSPEGLDLIFQSPPRSRDGIAPVWSENEVRNRLYTNWTGRGPANKPDEHLLEIAGEIAKQVFPKFGGWDDLASDPDKALAAADKYFQSQGDFPSIASLPAAIMLSPANSTVDFEGDYIAIDPAAETLLHQAVSRCAARLGRERPDLDQNKGPFVSSLQDALVSSQNNGLSWLFGVGFQHWKEKSPKELIDEYKVPADQHGAVTQVKSFVDAIPLNPLFDTTHYGEFRASVAGKVRSWVANYWKRLLDLKSLLATTEFTLPESISDPKAVSLFSGLLVDPQGLKKVADSLPARLVSAEEAIDRLMGVGIPTAADIAQVERVADEIGAFIGQVQQFNNQVKQKLENLQDADDEEFLKGLKIELPSGDKEPPAINRISGGAPDAAAEISELEEKLQRLLDARSEHFQTISEWAEENAVTLDPIAAMVELERLRLAERGATGDPEEYALRLLLQRIGRLANRVSPVSAGSIRELLKPVFMEEREFNLFFHNRLGSLYRSPYSTSRHQPFSIDVGKAKAIDWIAGLDQISSDIEKALSGAGEALGDQLRDWINLAGFAISQRLRGLPDTVPNALAQVRCPDDVRIPPLLAMLLEEDDIARDVCLKAFNLYVSAINGCLFGALREGFIVRTRFQRIGTDQIHYVPKDKAWEYPDRLNTAKGPINAAVSSDWIEKDGAVIKPVETVRNLSSTGFAGAGVSEYLVQAPHDWYTPLDLRDVAHLVTGLPVEKNITKLKRLTNRTAFRMVGASSFKTHLDSVLLSDKIKLGDFTIIIDQHYRQSVTYGGKVKISYEPERLQVEAAVPVVDTRDRTVPEPDTLFDHIVAIDLGERSVGFAVFDIKSCLRTGEVKPIHDNNGNPVVGTVAVPSIRRLMKAVRSHRRRRQPNQKVNQTYSTALQNYRENVIGDVCNRIDTLMERYNAFPVLEFQIKNFQAGAKQLEIVYGS

SEQ ID NO: 2473 - protein, 1307 aa, Acidaminococcus
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 2474 - protein, 1307 aa, Artificial Sequence
  Synthetic
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGEANLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 2475 - protein, 1228 aa, Lachnospiraceae
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2476 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGEANLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2477 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2478 - protein, 1305 aa, Artificial Sequence
  Synthetic
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKGQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 2479 - protein, 1303 aa, Artificial Sequence
  Synthetic
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKGKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 2480 - protein, 1301 aa, Artificial Sequence
  Synthetic
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAGGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 2481 - protein, 256 aa, Artificial Sequence
  Synthetic
  MISC_FEATURE (5)..(120): May be absent
  MISC_FEATURE (137)..(256): May be absent
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGSETPGTSESATPESSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 2482 - protein, 32 aa, Artificial Sequence; identical to SEQ ID NO: 385
  Synthetic
  MISC_FEATURE (5)..(8): May be absent
  MISC_FEATURE (25)..(32): May be absent

SEQ ID NO: 2483 - protein, 239 aa, Rattus rattus
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 2484 - protein, 396 aa, Rattus rattus
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFYWRKKFQKGLCTLWRSGIHVDVMDLPQFADCWTNFVNPQRPFRPWNELEKNSWRIQRRLRRIKESWGL

SEQ ID NO: 2485 - protein, 227 aa, Bos taurus
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAEIRFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 2486 - protein, 490 aa, Pan troglodytes
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 2487 - protein, 190 aa, Gorilla
MNPQIRNPMKAMYPGTFYFQFKNLWEANDRNETWLCFTVEGIKRRSVVSWKTGVFRNQVDSETHCHAERCFLSWFCDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 2488 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 2489 - protein, 185 aa, Bos taurus
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 2490 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 2491 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 2492 - protein, 224 aa, Mus musculus
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 2493 - protein, 224 aa, Rattus rattus
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 2494 - protein, 224 aa, Bos taurus
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 2495 - protein, 1824 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRK

SEQ ID NO: 2496 - protein, 173 aa, Bacteriophage Mu
AKPAKRIKSAAAAYVPQNRDAVITDIKRIGDLQREASRLETEMNDAIAEITEKFAARIAPIKTDIETLSKGVQGWCEANRDELTNGGKVKTANLVTGDVSWRVRPPSVSIRGMDAVMETLERLGLQRFIRTKQEINKEAILLEPKAVAGVAGITVKSGIEDFSIIPFEQEAGI

SEQ ID NO: 2497 - protein, 2013 aa, Artificial Sequence
  Synthetic
MAKPAKRIKSAAAAYVPQNRDAVITDIKRIGDLQREASRLETEMNDAIAEITEKFAARIAPIKTDIETLSKGVQGWCEANRDELTNGGKVKTANLVTGDVSWRVRPPSVSIRGMDAVMETLERLGLQRFIRTKQEINKEAILLEPKAVAGVAGITVKSGIEDFSIIPFEQEAGISGSETPGTSESATPESSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRK

SEQ ID NO: 2498 - protein, 30 aa, Artificial Sequence
  Synthetic
  MISC_FEATURE (2)..(30): May be absent
GGGGGGGGGGGGGGGGGGGGGGGGGGGGGG

SEQ ID NO: 2499 - protein, 4 aa, Artificial Sequence
  Synthetic
AGVF

SEQ ID NO: 2500 - protein, 4 aa, Artificial Sequence
  Synthetic
GFLG

SEQ ID NO: 2501 - protein, 4 aa, Artificial Sequence
  Synthetic
ALAL

SEQ ID NO: 2502 - protein, 5 aa, Artificial Sequence
  Synthetic
ALALA

What is claimed is:

1. A method of editing a polynucleotide encoding an ion channel in a dorsal root ganglion (DRG) neuron, the method comprising contacting the ion channel-encoding polynucleotide with:
   (i) a fusion protein comprising: (a) a guide nucleotide sequence-programmable DNA binding protein domain; and (b) a cytosine deaminase domain, wherein the fusion protein further comprises a uracil glycosylase inhibitor (UGI) domain; and
   (ii) a guide nucleic acid molecule targeting the fusion protein of (i) to a target cytosine (C) base in the ion channel-encoding polynucleotide;
   whereby the contacting results in deamination of the target C base by the fusion protein, resulting in a cytosine (C) to thymine (T) change in the ion channel-encoding polynucleotide; and
   wherein the C to T change leads to a mutation in the ion channel that either introduces a premature stop codon in the ion channel-coding polynucleotide that leads to a truncated or non-functional ion channel or destabilizes ion-channel protein folding, or both.

2. The method of claim 1, wherein the guide nucleotide sequence-programmable DNA binding protein domain is selected from the group consisting of: nuclease inactive Cas9 (dCas9) domains, nuclease inactive Cpf1 domains, nuclease inactive Argonaute domains, and variants thereof.

3. The method of claim 1, wherein the cytosine deaminase domain comprises an apolipoprotein B mRNA-editing complex (APOBEC) family deaminase.

4. The method of claim 1, wherein the cytosine deaminase domain is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, APOBEC3H deaminase, APOBEC4 deaminase, activation-induced deaminase (AID), and pmCDA1.

5. The method of claim 4, wherein the cytosine deaminase domain comprises the amino acid sequence of any one of SEQ ID NOs: 271-292, 303, or 2483-2494.

6. The method of claim 1, wherein the UGI domain comprises the amino acid sequence of SEQ ID NO: 304.

7. The method of claim 1, wherein the fusion protein comprises the amino acid sequence of any one of SEQ ID NOs: 296-302 and 2495.

8. The method of claim 1, wherein the C to T change occurs in the coding region of the ion channel-encoding polynucleotide.

9. The method of claim 1, wherein the mutation introduces a premature stop codon in the ion channel-coding sequence that leads to a truncated or non-functional ion channel.

10. The method of claim 1, wherein the mutation destabilizes ion-channel protein folding.

11. The method of claim 1, wherein the C to T change occurs at a C base-paired with the G base in a start codon (AUG).

12. The method of claim 1, wherein the C to T change occurs in the non-coding region of the ion channel-encoding polynucleotide.

13. The method of claim 1, wherein the ion channel is selected from the group consisting of: NaV1.7, NaV1.8, NaV1.9, NaV1.3, CaV3.2, HCN1, HCN2, and Ano1.

14. The method of claim 13, wherein the ion channel is NaV1.7 encoded by the SCN9A gene.

15. The method of claim 1, wherein a PAM sequence is either located 3' of the C being changed or is located 5' of the C being changed.

16. The method of claim 1, wherein the DRG neuron is in a mammal.

17. The method of claim 16, wherein the mammal is a human.

18. The method of claim 1, wherein a nucleic acid construct encoding the fusion protein is delivered to the DRG neuron via a neurotropic viral delivery vector.

19. The method of claim 9, wherein the mutation is installed at an amino acid position W188 of SEQ ID NO: 2434.

20. The method of claim 1, wherein the guide nucleotide sequence-programmable DNA binding protein domain is an S. pyogenes Cas9 nickase, an S. aureus Cas9 nickase, or an S. aureus Cas9-KKH.

21. The method of claim 20, wherein the guide nucleotide sequence-programmable DNA binding protein domain comprises an amino acid sequence having at least 95% sequence identity to any one of SEQ ID NOs: 3, 4, 268, or 2426-2428.

22. The method of claim 20, wherein the guide nucleotide sequence-programmable DNA binding protein domain comprises the amino acid sequence of any of SEQ ID NOs: 3, 4, 268, or 2426-2428.

23. The method of claim 4, wherein the cytosine deaminase domain comprises an amino acid sequence having at least 95% sequence identity to any one of SEQ ID NOs: 271-292, 303, or 2483-2494.

24. The method of claim 1, wherein the guide nucleic acid molecule is selected from SEQ ID NOs: 834-1125 or 1273-1287.

25. A method of editing a polynucleotide encoding an ion channel in a DRG neuron, the method comprising contacting the ion channel-encoding polynucleotide with:
(i) a fusion protein comprising: (a) a guide nucleotide sequence-programmable DNA binding protein domain; and (b) a cytosine deaminase domain; and
(ii) a guide nucleic acid molecule targeting the fusion protein of (i) to a target C base in the ion channel-encoding polynucleotide;
whereby the contacting results in deamination of the target C base by the fusion protein, resulting in a C to T change in the ion channel-encoding polynucleotide, and
wherein the guide nucleic acid molecule is selected from SEQ ID NOs: 339-1456.

26. A method of editing a polynucleotide encoding an ion channel in a dorsal root ganglion (DRG) neuron, the method comprising contacting the ion channel-encoding polynucleotide with:
(i) a fusion protein comprising: (a) a guide nucleotide sequence-programmable DNA binding protein domain; and (b) a cytosine deaminase domain, wherein the fusion protein further comprises a uracil glycosylase inhibitor (UGI) domain; and
(ii) a guide nucleic acid molecule targeting the fusion protein of (i) to a target cytosine (C) base in the ion channel-encoding polynucleotide;
whereby the contacting results in deamination of the target C base by the fusion protein, resulting in a cytosine (C) to thymine (T) change in the ion channel-encoding polynucleotide; and
wherein the ion channel-encoding polynucleotide comprises the nucleic acid sequence of SEQ ID NO: 2435 and/or wherein the ion channel-encoding polynucleotide comprises a sequence containing the target C that comprises the nucleic acid sequence of any one of SEQ ID NOs: 1457-1503.

27. The method of claim 26, wherein the ion channel comprises the amino acid sequence of SEQ ID NO: 2434.

28. A method of editing a polynucleotide encoding an ion channel in a dorsal root ganglion (DRG) neuron, the method comprising contacting the ion channel-encoding polynucleotide with:
(i) a fusion protein comprising: (a) a guide nucleotide sequence-programmable DNA binding protein domain; and (b) a cytosine deaminase domain, wherein the fusion protein further comprises a uracil glycosylase inhibitor (UGI) domain; and
(ii) a guide nucleic acid molecule targeting the fusion protein of (i) to a target cytosine (C) base in the ion channel-encoding polynucleotide, wherein the guide nucleic acid molecule is selected from SEQ ID NOs: 834-1125 or 1273-1287;
whereby the contacting results in deamination of the target C base by the fusion protein, resulting in a cytosine (C) to thymine (T) change in the ion channel-encoding polynucleotide.

* * * * *